US011421011B2

(12) United States Patent
Mishra et al.

(10) Patent No.: US 11,421,011 B2
(45) Date of Patent: Aug. 23, 2022

(54) POLYNUCLEOTIDES ENCODING TETHERED INTERLEUKIN-12 (IL12) POLYPEPTIDES AND USES THEREOF

(71) Applicant: ModernaTX, Inc., Cambridge, MA (US)

(72) Inventors: Ankita Mishra, Cambridge, MA (US); Joshua Frederick, Charlestown, MA (US); Sushma Gurumurthy, Sharon, MA (US)

(73) Assignee: ModernaTX, Inc., Cambridge, MA (US)

( * ) Notice: Subject to any disclaimer, the term of this patent is extended or adjusted under 35 U.S.C. 154(b) by 0 days.

(21) Appl. No.: 16/613,732

(22) PCT Filed: May 18, 2018

(86) PCT No.: PCT/US2018/033436
§ 371 (c)(1),
(2) Date: Nov. 14, 2019

(87) PCT Pub. No.: WO2018/213731
PCT Pub. Date: Nov. 22, 2018

(65) Prior Publication Data
US 2020/0102363 A1    Apr. 2, 2020

Related U.S. Application Data

(60) Provisional application No. 62/508,316, filed on May 18, 2017.

(51) Int. Cl.
*C07K 14/54* (2006.01)
*A61K 9/51* (2006.01)
*A61K 38/00* (2006.01)

(52) U.S. Cl.
CPC ........ *C07K 14/5434* (2013.01); *A61K 9/5123* (2013.01); *A61K 38/00* (2013.01); *C07K 2319/03* (2013.01)

(58) Field of Classification Search
CPC ............ C07K 14/5434; C07K 2319/03; A61K 9/5123; A61K 38/00
See application file for complete search history.

(56) References Cited

U.S. PATENT DOCUMENTS

| | | | |
|---|---|---|---|
| 5,891,680 A | 4/1999 | Lieschke et al. |
| 5,922,685 A | 7/1999 | Rakhmilevich et al. |
| 5,994,104 A | 11/1999 | Anderson et al. |
| 6,423,308 B1 | 7/2002 | Yarchoan et al. |
| 6,509,321 B1 | 1/2003 | Yarchoan et al. |
| 7,320,890 B2 | 1/2008 | Mahato et al. |
| 7,595,303 B1 | 9/2009 | Mohapatra et al. |
| 7,833,754 B2 | 11/2010 | Felber et al. |
| 7,872,107 B2 | 1/2011 | Webster et al. |
| 7,910,564 B2 | 3/2011 | Sung et al. |
| 8,026,223 B1 | 9/2011 | Heller et al. |
| 8,188,248 B2 | 5/2012 | Webster et al. |
| 8,253,151 B2 | 8/2012 | Kang |
| 8,556,882 B2 | 10/2013 | Morgan et al. |
| 8,603,458 B2 | 12/2013 | Mohapatra et al. |
| 8,715,964 B2 | 5/2014 | Felber et al. |
| 9,029,330 B2 | 5/2015 | Webster et al. |
| 9,272,024 B2 | 3/2016 | Weiner et al. |
| 9,636,388 B2 | 5/2017 | Lawman et al. |
| 9,868,691 B2 | 1/2018 | Benenato |
| 9,981,036 B2 | 5/2018 | Weiner et al. |
| 10,646,549 B2 * | 5/2020 | Frederick ........... A61K 31/7115 |
| 2002/0018767 A1 | 2/2002 | Lee et al. |
| 2003/0118564 A1 | 6/2003 | Moiling et al. |
| 2005/0032730 A1 | 2/2005 | Von Der Mulbe et al. |
| 2009/0053171 A1 | 2/2009 | Hwang et al. |
| 2014/0004154 A1 | 1/2014 | Pascolo |
| 2014/0056931 A1 | 2/2014 | Mohapatra et al. |
| 2014/0206758 A1 | 7/2014 | Felber et al. |
| 2015/0004188 A1 | 1/2015 | Weiner et al. |
| 2016/0311879 A1 | 10/2016 | Sopczynski et al. |
| 2017/0000870 A1 | 1/2017 | Hoerr et al. |
| 2017/0232090 A1 | 8/2017 | Lawman et al. |
| 2017/0291934 A1* | 10/2017 | Reed ..................... C07K 14/54 |
| 2018/0207295 A1 | 7/2018 | Fotin-Mleczek et al. |
| 2019/0125839 A1 | 5/2019 | Frederick et al. |

FOREIGN PATENT DOCUMENTS

| | | |
|---|---|---|
| EP | 1032428 B1 | 6/2003 |
| EP | 1640018 A1 | 3/2006 |
| EP | 1268759 B1 | 9/2006 |
| EP | 1966238 B1 | 4/2012 |
| EP | 2623121 A1 | 8/2013 |
| EP | 2424887 B1 | 9/2015 |
| EP | 3053592 A1 | 8/2016 |
| EP | 3250250 A1 | 12/2017 |
| EP | 3326641 A1 | 5/2018 |
| EP | 3173092 B1 | 6/2019 |
| WO | 96/24676 A1 | 8/1996 |
| WO | 97/46263 | 12/1997 |
| WO | 98/17814 A2 | 4/1998 |
| WO | 99/26663 A2 | 6/1999 |
| WO | 200152874 A2 | 7/2001 |
| WO | 01/62274 A1 | 8/2001 |
| WO | 02/098443 A2 | 12/2002 |
| WO | 2005/058349 A2 | 6/2005 |

(Continued)

OTHER PUBLICATIONS

U.S. Appl. No. 16/192,274, filed Nov. 15, 2018, Joshua Frederick.

(Continued)

*Primary Examiner* — J. E. Angell
(74) *Attorney, Agent, or Firm* — Cooley LLP; Amy Mandragouras; Ariana D. Harris

(57) ABSTRACT

The present disclosure relates to polynucleotides encoding tethered interleukin-12 (IL-12) polypeptides comprising an IL-12 polypeptide and a membrane domain. The present disclosure also relates to vectors comprising the polynucleotides; host cells comprising the polynucleotides or vectors; polypeptides encoded by the polynucleotides; compositions comprising the polynucleotides, vectors, host cells, or polypeptides and a delivery agent; and uses thereof, including treatment of cancer.

46 Claims, 13 Drawing Sheets

Figure 1A:
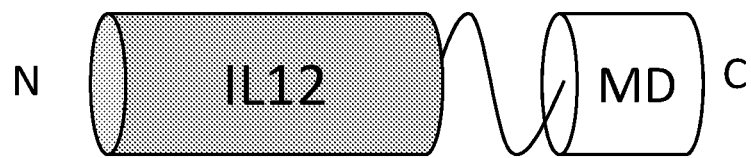
Figure 1B:
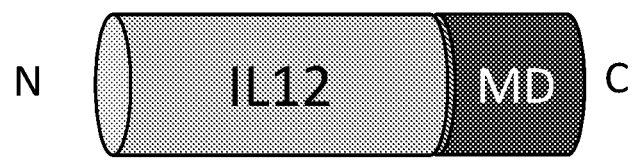
Figure 1C:
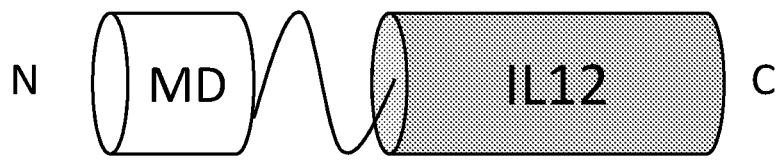
Figure 1D:
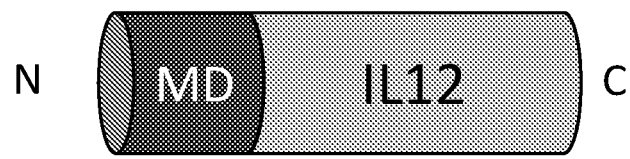

Specification includes a Sequence Listing.

(56) References Cited

FOREIGN PATENT DOCUMENTS

| | | |
|---|---|---|
| WO | 2006/024518 A1 | 3/2006 |
| WO | 2008052770 A2 | 5/2008 |
| WO | 2008134879 A1 | 11/2008 |
| WO | 2009034172 A1 | 3/2009 |
| WO | 2009/149539 A1 | 12/2009 |
| WO | 2010/126766 A1 | 11/2010 |
| WO | 2012116811 A1 | 9/2012 |
| WO | 2013/053775 | 4/2013 |
| WO | 2013/090296 A1 | 6/2013 |
| WO | 2013/151671 A1 | 10/2013 |
| WO | 2013051672 A2 | 10/2013 |
| WO | 2014089486 A1 | 6/2014 |
| WO | 2014/127917 A1 | 8/2014 |
| WO | 2015/058069 A1 | 4/2015 |
| WO | 2015/061491 A1 | 4/2015 |
| WO | 2015/095249 A1 | 6/2015 |
| WO | 2016/048903 A1 | 3/2016 |
| WO | 2016/170176 A1 | 10/2016 |
| WO | WO 2017/062513 A1 | 4/2017 |
| WO | 2017/137461 A1 | 8/2017 |
| WO | 2017/144602 A1 | 8/2017 |
| WO | 2017/201350 A1 | 11/2017 |
| WO | 2018/033254 A2 | 2/2018 |
| WO | 2018/068008 A1 | 4/2018 |

OTHER PUBLICATIONS

U.S. Appl. No. 16/192,274, filed Sep. 18, 2019, J. Angell.
U.S. Appl. No. 16/192,274, filed Mar. 7, 2019, J. Angell.
Amos, S.M. et al., "Adoptive immunotherapy combined with intrautmoral TLR agonist delivery eradicates established melanoma in mice," Cancer Immunology and Immunotherapy, vol. 60(5):671-683 (2011).
Anwer, K. et al., "Phase-I clinical trial of IL-12 plasnnid/ lipopolynner complexes for the treatment of recurrent ovarian cancer," Gene Therapy, vol. 17:360-369 (2009).
Bontkes, H. J., et al., "Dendritic cells transfected with interleukin-12 and tumor-associated antigen messenger RNA induce high avidity cytotoxic T cells," Gene Therapy, vol. 14: 366-375 (2007).
Bontkes, H. J., et al., "Tumor associated antigen arid interleukin-12 mRNA transfected dendrific cells enhance effector function of natural killer cells and antigen specific T-cells," Clinical Immunology, vol. 127(3): 375-384 (2008).
Chakrabarti R. et al., "Plasmids encoding membrane-bound IL-4 or IL-12 strongly costimulate DNA vaccination against carcinoembryonic antigen (CEA)," VAC, vol. 22(9-10):1199-1205 (2004).
Charoensit, P. et al., "Enhanced growth inhibition of metastatic lung tumors by intravenous injection of ATRA-cationic liposome/IL-12 pDNA complexes in mice," Cancer Gene Therapy, vol. 17(7) 512-522 (2010).
Chen, J. et al., Production and clinical development of nanopartides for gene delivery, Official journal of the American Society of Gene & Cell Therapy, vol. 3 (16023) 8 pages (2016).
Chowdhury, F.Z. et al., "IL-12 selectively programs effector pathways that are stably expressed in human CD8+ effector memory T cells in vivo," Blood, vol. 118 (14):3890-3900 (2011).
Colombo, M. et al., "Interieukin-12 in anti-tumor immunity and immunotherapy," Cytokine and Growth Factor Reviews, vol. 13 (2):155-168 (2002).
Communication pursuant to Rule 114(2) EPC, issued by the European Patent Office dated Feb. 10, 2020 (6 pgs).
Fotin-Mleczek, M. et al., "Highly potent mRNA based cancer vaccines represent an attractive platform for combination therapies supporting an improved therapeutic effect," Journal of Gene Medicine, vol. 14 (6):428-439 (2012).
International Preliminary Report on Patentability, PCT/US2017/033422, dated Nov. 20, 2018, 10 pages.
International Preliminary Report on Patentability, PCT/US2018/033436, dated Nov. 19, 2019, 13 pages.
International Search Report and Written Opinion, PCT/US2017/033422, dated Jul. 19, 2017, 15 pages.
International Search Report and Written Opinion, PCT/US2018/033436, dated Oct. 26, 2018, 20 pages.
Jian, Database Accession, AN 2010-E33821 & CN 101 684 456 A (Jiangmen Luosen Bio-Pharmaceutical Co Ltd) Thomson Scientific, abstract Mar. 31, 2010, 2 pages.
Kauffman, et at. "Materials for non-viral Intracellular Delivery of Messenger RNA Therapeutics," Journal of Controlled Release (2016), v. 240, pp. 227-234.
Lasek, W. et al., "Interleukin 12: still a promising candidate for tumor immunotherapy?," Cancer Immunol Immunother., vol. 63:419-435 (2014).
Mahvi, DM, et al., "Intratumoral injection of IL-12 plasmid DNA—results of a phase; I/IB clinical trial," Cancer Gene Therapy, vol. 14: 717-723 (2007).
Meraz, I. et al., "Adjuvant Cationic Liposomes Presenting MPL and IL-12 Induce Cell Death, Suppress Tumor Growth, and Alter the Cellular Phenotype of Tumors in a Murine Model of Breast Cancer," Molecular Pharmaceutics, vol. 11(10):3484-3491(2014).
Pan, W-Y, et al., "Cancer Immunotherapy Using a Membrane-bound Interleukin-12 With B7-1 Transmembrane and Cytoplasmic Domains," Molecular Therapy, The Journal of the American Society of Gene Therapy, vol. 20(5):927-937 (2012).
Poutou, J. et al., "Safety and antitumor effect of oncolytic and helper-dependent adenoviruses expressing interleukin-12 variants in a hamster pancreatic cancer model," Gene Therapy, vol. 22(9):696-706 (2015).
Putzer B. M. et al. "Interleukin 12 and B7-1 costimulatory molecule expressed by an adenovirus vector act synergistically to facilitate tumor regression," PNAS, vol. 94 (20):10889-10894 (1997).
Reichmuth, et al., "mRNA Vaccine Delivery Using Lipid Nanoparticles," Therapeutic Delivery (2016), v. 7, No. 5, pp. 319-334.
Sahin, U. et al., "mRNA-based therapeutics—developing a new class of drugs," Nature Reviews Drug Discovery, vol. 13(10):759-780 (2014).
Sayour, E.J. et al., "Bridging infectious disease vaccines with cancer immunotherapy: a role for targeted RNA based immunotherapeutics," Journal for Imunotherapy of Cancer, vol. 3(1): 7 pages (2015).
Schirrmacher V., et al., "Intra-pinna anti-tumor vaccination with self-replicating infectious RNA or with DNA encoding a model tumor antigen and a cytokine," Gene Therapy, vol. 7(13):1137-1147 (2000).
Shim, G. et al., "Application of cationic liposomes for delivery of nucleic acids," Asian Journal of Pharmaceutical Sciences, vol. 8 (2):72-80 (2013).
Suzuki, R. et al., "Cancer gene therapy by IL-12 gene delivery using liposomal bubbles and tumoral ultrasound exposure" Journal of Controlled Release, vol. 142: 245-250(2009).
Tao, M-H et al., "Membrane-bound interleukin 12 induced stronger antitumor immunity than soluble interleukin 12 without inducing circulating interferon [gamma]," Cancer Research, vol. 65(9):1410 (2005).
Third Party Observation, filed in PCT/US2017/033422, dated Sep. 17, 2018, 5 pages.
Tugues, S. et al., "New insights into IL-12-mediated tumor suppression," Cell Death and Differentiation, vol. 22(2):237-246 (2014).
Van Der Jeught, K. et al., "Intratumoral administration of mRNA encoding a fusokine; consisting of IFN-? and the ectodomain of the TGF-? receptor II potentiates antitumor immunity," Oncotarget, vol. 5 (20):10100-10113 (2014).
Van Der Jeught, K. et al., "Intratumoral delivery of mRNA: Overcoming obstacles for effective immunotherapy," OncoImmunolog, vol. 4(5): e1005504-1-e1005504-3 (2015).
Van Der Jeught, K. et al., "Targeting the tumor microenvironment to enhance antitumor immune responses," Oncotarget, vol. 6(3): 1359-1381(2014).
Wilgenhof S., et al., "A phase IB study on intravenous synthetic mRNA electroporated dendritic cell immunotherapy in pretreated advanced melanoma patients," Annals of Oncology, vol. 24 (10): 2686-2693(2013).

(56) References Cited

OTHER PUBLICATIONS

Yang, X. et al., "Mouse interleukin-12/FasTI: A novel bi-functional fusion protein for cancer immuno/gene therapy," International Journal of Oncology, vol. 48(6): 2381-2386(2016).

* cited by examiner

"mIL12-8TM"
CD8 TM

"mIL12-PTM"
PDGFR TM

"mIL12-80TID"
CD80 TM & ICD

"mIL12-80TM"
CD80 TM

"IgK_mscIL12-80TID"
CD80 TM & ICD

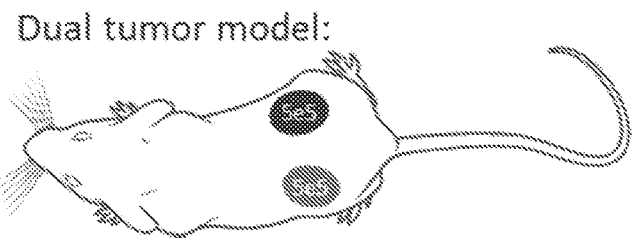
FIG. 8A
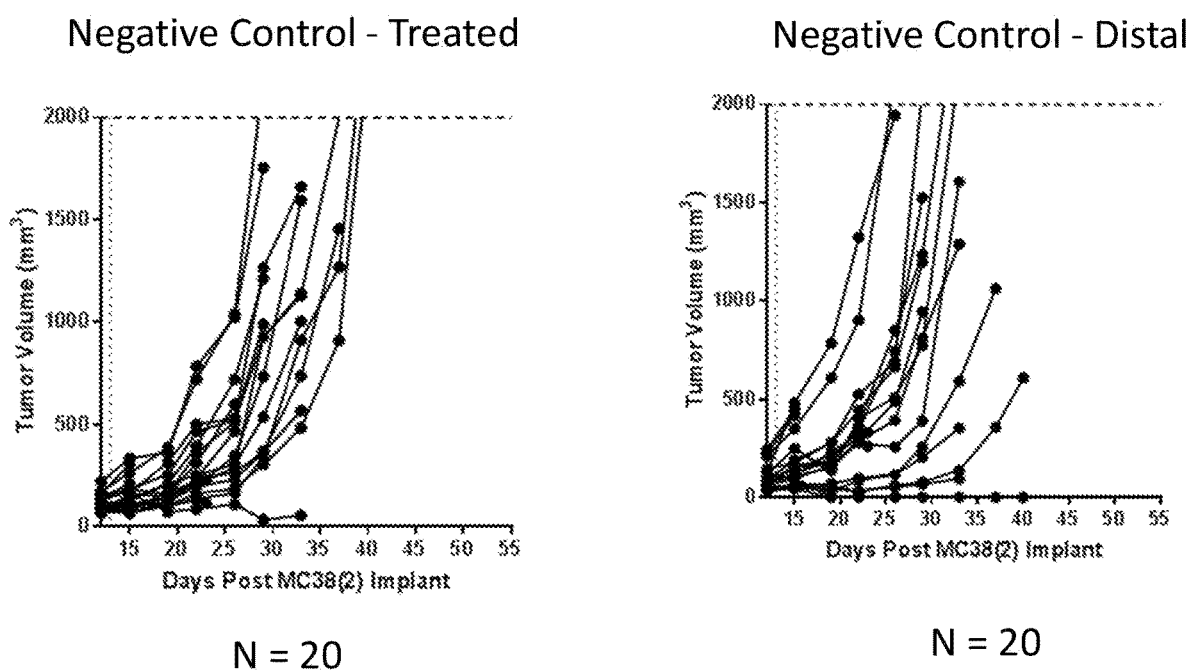
FIG. 8B  FIG. 8C

"hIL12-8TM"
CD8 TM

"hIL12-80TID"
CD80 TM & ICD

"hIL12-PTIDE570"
PGFRB TM & truncated ICD

"IL-12PTIDG739"
PGFRB TM & truncated ICD

POLYNUCLEOTIDES ENCODING TETHERED INTERLEUKIN-12 (IL12) POLYPEPTIDES AND USES THEREOF

RELATED APPLICATIONS

This application is a 35 U.S.C. § 371 national stage filing of International Application No. PCT/US2018/033436, filed May 18, 2018, which claims the benefit of U.S. Provisional Application Ser. No. 62/508,316 filed on May 18, 2017. The entire contents of the above-referenced applications are incorporated herein by this reference.

REFERENCE TO SEQUENCE LISTING

The instant application contains a Sequence Listing which has been submitted electronically in ASCII format via EFS-Web, and is hereby incorporated by reference in its entirety. Said ASCII copy, created on Nov. 14, 2019, is named Sequence_Listing_MDN_814US.txt and is 800566 bytes in size.

BACKGROUND

Interleukin-12 (IL-12) is a pro-inflammatory cytokine that plays an important role in innate and adaptive immunity. Gately, M K et al., *Annu Rev Immunol.* 16: 495-521 (1998). IL-12 functions primarily as a 70 kDa heterodimeric protein consisting of two disulfide-linked p35 and p40 subunits. IL-12 p40 homodimers do exist, but other than functioning as an antagonist that binds the IL-12 receptor, they do not appear to mediate a biologic response. Id. The precursor form of the IL-12 p40 subunit (NM_002187; P29460; also referred to as IL-12B, natural killer cell stimulatory factor 2, cytotoxic lymphocyte maturation factor 2) is 328 amino acids in length, while its mature form is 306 amino acids long. The precursor form of the IL-12 p35 subunit (NM_000882; P29459; also referred to as IL-12A, natural killer cell stimulatory factor 1, cytotoxic lymphocyte maturation factor 1) is 219 amino acids in length and the mature form is 197 amino acids long. Id. The genes for the IL-12 p35 and p40 subunits reside on different chromosomes and are regulated independently of each other. Gately, M K et al., *Annu Rev Immunol.* 16: 495-521 (1998). Many different immune cells (e.g., dendritic cells, macrophages, monocytes, neutrophils, and B cells) produce IL-12 upon antigenic stimuli. The active IL-12 heterodimer is formed following protein synthesis. Id.

Due to its ability to activate both NK cells and cytotoxic T cells, IL-12 protein has been studied as a promising anti-cancer therapeutic since 1994. See Nastala, C. L. et al., *J Immunol* 153: 1697-1706 (1994). But despite high expectations, early clinical studies did not yield satisfactory results. Lasek W. et al., *Cancer Immunol Immunother* 63: 419-435, 424 (2014). Repeated administration of IL-12, in most patients, led to adaptive response and a progressive decline of IL-12-induced interferon gamma (IFNγ) levels in blood. Id. Moreover, while it was recognized that IL-12-induced anti-cancer activity is largely mediated by the secondary secretion of IFNγ, the concomitant induction of IFNγ along with other cytokines (e.g., TNF-α) or chemokines (IP-10 or MIG) by IL-12 caused severe toxicity. Id. In addition to the negative feedback and toxicity, the marginal efficacy of the IL-12 therapy in clinical settings may be caused by the strong immunosuppressive environment in humans. Id. To minimize IFNγ toxicity and improve IL-12 efficacy, scientists tried different approaches, such as different dose and time protocols for IL-12 therapy. See Sacco, S. et al., *Blood* 90: 4473-4479 (1997); Leonard, J. P. et al., *Blood* 90: 2541-2548 (1997); Coughlin, C. M. et al., *Cancer Res.* 57: 2460-2467 (1997); Asselin-Paturel, C. et al., *Cancer* 91: 113-122 (2001); and Saudemont, A. et al., *Leukemia* 16: 1637-1644 (2002). Nonetheless, these approaches have not significantly impacted patient survival. Kang, W. K., et al., *Human Gene Therapy* 12: 671-684 (2001).

Membrane-anchored versions of IL-12 have been studied as a means of reducing toxicity associated with systemic administration, using retroviral and adenoviral vectors for expression in tumor cells. See Pan, W-Y. et al., *Mol. Ther.* 20(5): 927-937 (2012). But, the use of viral vectors presents a potential health risk, since the underlying viruses can act as oncogenes and the viral vectors can be immunogenic.

Currently, a number of IL-12 clinical trials are on-going. Though these multiple clinical trials have been on-going for nearly 20 years since the first human clinical trial of IL-12 in 1996, an FDA-approved IL-12 product is still not available. Thus, there is a need in the art for an improved therapeutic approach for using IL-12 to treat tumors.

SUMMARY OF THE DISCLOSURE

The present disclosure is directed to novel tethered interleukin-12 (IL-12)-encoding polynucleotides (e.g., mRNAs) for use in treating cancer.

Although IL-12 has been shown to have potent anti-tumor activity, its clinical application is limited by severe systemic toxicity. Several strategies have been employed to address this limitation, which appear promising. The present disclosure is based, at least in part, on a strategy of anchoring an IL-12 polypeptide to a cell membrane by delivering an mRNA encoding an IL-12 polypeptide to the cell, thereby generating a tethered IL-12 polypeptide with reduce systemic distribution. Further, the present disclosure is based on the discovery that tethered IL-12 polypeptides, encoded by mRNA, remain substantially tethered to the cell surface (i.e., are not substantially released by cells expressing the mRNA encoded IL-12 polypeptide), thereby reducing systemic distribution. It has also been discovered that mRNA encoded tethered IL-12 polypeptides retain IL-12 bioactivity. Specifically, mRNA encoding a tethered IL-12 polypeptide as described herein was shown to induce an anti-tumor immune response, as indicated by an increase in CD8+ T cell proliferation and IFNγ secretion, along with a reduction in tumor burden in vivo in both treated and non-treated (i.e., distal) tumors.

Accordingly, in one aspect, the disclosure provides a polynucleotide comprising an open reading frame (ORF) comprising: (a) a first nucleic acid sequence encoding an Interleukin 12 p40 subunit (IL-12B), (b) a second nucleic acid sequence encoding an Interleukin 12 p35 subunit (IL-12A), and (c) a nucleic acid sequence encoding a transmembrane domain, wherein the first nucleic acid sequence and the second nucleic acid sequence are linked by a nucleic acid sequence encoding a linker ("subunit linker"), and wherein the nucleic acid sequence encoding the transmembrane domain is linked to the first or second nucleic acid sequence by a nucleic acid sequence encoding a linker ("transmembrane domain linker").

In some embodiments, the first nucleic acid sequence is located at the 5' end of the subunit linker.

In some embodiments, the nucleic acid sequence encoding the transmembrane domain is located at the 3' end of the transmembrane domain linker.

In some embodiments, the polynucleotide further comprises a nucleic acid sequence encoding a signal peptide. In some embodiments, the nucleic acid sequence encoding the signal peptide is located at the 5' end of the first nucleic acid sequence.

In some embodiments, the IL-12B has an amino acid sequence at least about 80%, at least about 90%, at least about 95%, at least 96%, at least 97%, at least 98%, at least 99%, or 100% identical to amino acids 23 to 328 of SEQ ID NO: 48, and wherein the amino acid sequence has IL-12B activity.

In some embodiments, the IL-12A has an amino acid sequence at least about 80%, at least about 90%, at least about 95%, at least 96%, at least 97%, at least 98%, at least 99%, or 100% identical to amino acids 336 to 532 of SEQ ID NO: 48, and wherein the amino acid sequence has IL-12A activity.

In some embodiments, the signal peptide comprises a sequence at least about 80%, at least about 90%, at least about 95%, at least 96%, at least 97%, at least 98%, at least 99%, or 100% identical to amino acids 1 to 22 of SEQ ID NO: 48.

In some embodiments, the subunit linker is a Gly/Ser linker. In some embodiments, the transmembrane domain linker is a Gly/Ser linker. In some embodiments, the Gly/Ser linker comprises $(G_nS)_m$, wherein n is 1, 2 3, 4, 5, 6, 7, 8, 9, 10, 15, or 20 and m is 1, 2, 3, 4, 5, 6, 7, 8, 9, 10, 15, or 20.

In some embodiments, the transmembrane domain is a type I transmembrane domain. In some embodiments, the transmembrane domain is a Cluster of Differentiation 8 (CD8) transmembrane domain or a Platelet-Derived Growth Factor Receptor (PDGF-R) transmembrane domain.

In some embodiments, the polynucleotide is DNA. In some embodiments, the polynucleotide is RNA. In some embodiments, the polynucleotide is mRNA.

In some embodiments, the polynucleotide comprises at least one chemically modified nucleobase.

In some embodiments, the at least one chemically modified nucleobase is selected from the group consisting of pseudouracil (ψ), N1-methylpseudouracil (m1ψ), 2-thiouracil (s2U), 4'-thiouracil, 5-methylcytosine, 2-thio-1-methyl-1-deaza-pseudouracil, 2-thio-1-methyl-pseudouracil, 2-thio-5-aza-uracil, 2-thio-dihydropseudouracil, 2-thio-dihydrouracil, 2-thio-pseudouracil, 4-methoxy-2-thio-pseudouracil, 4-methoxy-pseudouracil, 4-thio-1-methyl-pseudouracil, 4-thio-pseudouracil, 5-aza-uracil, dihydropseudouracil, 5-methyluracil, 5-methoxyuracil, 2'-O-methyl uracil, 1-methyl-pseudouracil (m1ψ), 5-methoxy-uracil (mo5U), 5-methyl-cytosine (m5C), α-thio-guanine, α-thio-adenine, 5-cyano uracil, 4'-thio uracil, 7-deaza-adenine, 1-methyl-adenine (m1A), 2-methyl-adenine (m2A), N6-methyl-adenine (m6A), and 2,6-Diaminopurine, (I), 1-methyl-inosine (m1I), wyosine (imG), methylwyosine (mimG), 7-deaza-guanine, 7-cyano-7-deaza-guanine (preQ0), 7-aminomethyl-7-deaza-guanine (preQ1), 7-methyl-guanine (m7G), 1-methyl-guanine (m1G), 8-oxo-guanine, 7-methyl-8-oxo-guanine, and two or more combinations thereof.

In some embodiments, the nucleobases in the polynucleotide are chemically modified by at least about 10%, at least about 20%, at least about 30%, at least about 40%, at least about 50%, at least about 60%, at least about 70%, at least about 80%, at least about 90%, at least 95%, at least 99%, or 100%. In some embodiments, the chemically modified nucleobases are selected from the group consisting of uracil, adenine, cytosine, guanine, and any combination thereof.

In some embodiments, the uracils, adenines, cytosines or guanines are chemically modified by at least about 10%, at least about 20%, at least about 30%, at least about 40%, at least about 50%, at least about 60%, at least about 70%, at least about 80%, at least about 90%, at least 95%, at least 99%, or 100%.

In some embodiments, the polynucleotide further comprises a nucleic acid sequence comprising a miRNA binding site. In some embodiments, the miRNA binding site binds to miR-122. In some embodiments, the miRNA binding site binds to miR-122-3p or miR-122-5p.

In some embodiments, the polynucleotide further comprises a 5' UTR. In some embodiments, the 5' UTR comprises a nucleic acid sequence at least 90%, 95%, 96%, 97%, 98%, 99%, or 100% identical to any one of sequences disclosed herein.

In some embodiments, the polynucleotide further comprises a 3' UTR. In some embodiments, the 3' UTR comprises a nucleic acid sequence at least about 90%, at least about 95%, at least 96%, at least 97%, at least 98%, at least 99%, or 100% identical to any one of sequences disclosed herein. In some embodiments, the miRNA binding site is located within the 3' UTR.

In some embodiments, the 5' UTR comprises a 5' terminal cap.

In some embodiments, the 5' terminal cap is a Cap0, Cap1, ARCA, inosine, N1-methyl-guanosine, 2'fluoro-guanosine, 7-deaza-guanosine, 8-oxo-guanosine, 2-amino-guanosine, LNA-guanosine, 2-azidoguanosine, Cap2, Cap4, 5' methylG cap, or an analog thereof.

In some embodiments, the polynucleotide further comprises a poly-A region. In some embodiments, the poly-A region is at least about 10, at least about 20, at least about 30, at least about 40, at least about 50, at least about 60, at least about 70, at least about 80, or at least about 90 nucleotides in length. In some embodiments, the poly-A region has about 10 to about 200 nucleotides in length, about 20 to about 180 nucleotides in length, about 30 to about 160 nucleotides in length, about 40 to about 140 nucleotides in length, about 50 to about 120 nucleotides in length, about 60 to about 100 nucleotides in length, or about 80 to about 90 nucleotides in length.

In some embodiments, the polynucleotide has been transcribed in vitro (IVT). In some embodiments, the polynucleotide is chimeric. In some embodiments, the polynucleotide is circular.

In some embodiments, the ORF further comprises one or more nucleic acid sequences encoding one or more heterologous polypeptides fused to the nucleic acid sequence encoding the IL-12B, the IL-12A, or both. In some embodiments, the one or more heterologous polypeptides increase a pharmacokinetic property of the IL-12A, the IL-12B, or both.

In some embodiments, the polynucleotide is single stranded. In some embodiments, the polynucleotide is double stranded.

In some embodiments, the IL-12B is a variant, derivative or mutant having an IL-12B activity. In some embodiments, the IL-12A is a variant, derivative, or mutant having an IL-12A activity. In another aspect, the disclosure provides a vector comprising any of the above polynucleotides.

In another aspect, the disclosure provides a composition comprising (i) any of the above polynucleotides or vector, and (ii) a delivery agent. In some embodiments, the delivery agent comprises a lipid nanoparticle. In some embodiments, the lipid nanoparticle comprises the compound of formula (I). In some embodiments, the delivery agent further comprises a phospholipid. In some embodiments, the delivery agent further comprises a structural lipid. In some embodiments, the structural lipid is cholesterol. In some embodiments, the delivery agent further comprises a PEG lipid.

In some embodiments, the delivery agent further comprises a quaternary amine compound. In another aspect, the disclosure provides a method of reducing the size of a tumor or inhibiting growth of a tumor in a subject in need thereof comprising administering any of the above polynucleotides, vector, or compositions in the subject. In some embodiments, the polynucleotide, vector, or composition is administered subcutaneously, intravenously, intraperitoneally, or intratumorally.

In some embodiments, the administration treats a cancer. In some embodiments, the polynucleotide is administered intratumorally to the subject. In some embodiments, the polynucleotide is administered at an amount between about 0.10 µg per tumor and about 1000 mg per tumor.

In some embodiments, the method further comprises administering an anti-cancer agent. In some embodiments, the anti-cancer agent comprises (i) an antibody or antigen-binding fragment thereof that specifically binds to PD-1 or PD-L1 (anti-PD-1 antibody or anti-PD-L1 antibody, respectively) or a polynucleotide encoding the anti-PD-1 or anti-PD-L1 antibody or antigen-binding fragment thereof, (ii) an antibody or antigen-binding fragment thereof that specifically binds to CTLA-4 (anti-CTLA-4 antibody) or a polynucleotide encoding the anti-CTLA-4 antibody or antigen-binding fragment thereof, or (iii) an anti-PD-1 or anti-PD-L1 antibody or antigen-binding fragment thereof or a polynucleotide encoding the anti-PD-1 or anti-PD-L1 antibody or antigen-binding fragment thereof, and an anti-CTLA-4 antibody or antigen-binding fragment thereof or a polynucleotide encoding the anti-CTLA-4 antibody or antigen-binding fragment thereof.

In some embodiments, the administration reduces the size of a tumor or inhibits growth of a tumor at least 1.5 fold, at least 2 fold, at least 2.5 fold, at least 3 fold, at least 3.5 fold, at least 4 fold, at least 4.5 fold, or at least 5 fold better than (i) an administration of a polynucleotide encoding IL-12 alone, (ii) an administration of the anti-PD-1 or anti-PD-L1 antibody alone, or (iii) an administration of the anti-CTLA-4 antibody alone.

In some embodiments, the polynucleotide encoding the anti-PD-1, anti-PD-L1, or anti-CTLA-4 antibody or antigen-binding fragment thereof comprises an mRNA.

In some embodiments, the polynucleotide encoding the anti-PD-1, anti-PD-L1, or anti-CTLA-4 antibody or antigen-binding fragment thereof comprises at least one chemically modified nucleoside.

In some embodiments, the at least one chemically modified nucleoside is selected from any chemically modified nucleoside disclosed herein and a combination thereof.

In some embodiments, the at least one chemically modified nucleoside is selected from the group consisting of pseudouridine, N1-methylpseudouridine, 5-methylcytosine, 5-methoxyuridine, and a combination thereof.

In some embodiments, the mRNA encoding the anti-PD-1, anti-PD-L1, or anti-CTLA-4 antibody or antigen-binding fragment thereof comprises an open reading frame. In some embodiments, the anti-PD-L1 antibody is atezolizumab, avelumab, or durvalumab. In some embodiments, the anti-CTLA-4 antibody is tremelimumab or ipilimumab.

In some aspects, the disclosure provides a polynucleotide comprising an open reading frame (ORF) encoding a human interleukin-12 (IL-12) polypeptide operably linked to a membrane domain, optionally via a linker, wherein the human IL-12 polypeptide comprises an IL-12 p40 subunit (IL-12B) polypeptide operably linked to an IL-12 p35 subunit (IL-12A) polypeptide, wherein the membrane domain comprises a transmembrane domain, and wherein the polynucleotide is an mRNA comprising a 5' untranslated region (UTR), the ORF, and a 3' UTR.

In some aspects, the disclosure provides a polynucleotide comprising an open reading frame (ORF) encoding a human interleukin-12 (IL-12) polypeptide operably linked to a membrane domain, optionally via a linker, wherein the human IL-12 polypeptide comprises an IL-12 p40 subunit (IL-12B) polypeptide operably linked to an IL-12 p35 subunit (IL-12A) polypeptide, wherein the membrane domain comprises a transmembrane domain derived from a Type I integral membrane protein, and wherein the polynucleotide is an mRNA comprising a 5' untranslated region (UTR), the ORF, and a 3' UTR.

In some aspects, the transmembrane domain is selected from the group consisting of: a Cluster of Differentiation 8 (CD8) transmembrane domain, a Platelet-Derived Growth Factor Receptor (PDGFR) transmembrane domain, and a Cluster of Differentiation 80 (CD80) transmembrane domain.

In some aspects, the disclosure provides a polynucleotide comprising an open reading frame (ORF) encoding a human interleukin-12 (IL-12) polypeptide operably linked to a membrane domain, optionally via a linker, wherein the human IL-12 polypeptide comprises an IL-12 p40 subunit (IL-12B) polypeptide operably linked to an IL-12 p35 subunit (IL-12A) polypeptide, wherein the membrane domain comprises a Cluster of Differentiation 8 (CD8) transmembrane domain, and wherein the polynucleotide is an mRNA comprising a 5' untranslated region (UTR), the ORF, and a 3' UTR. In some aspects, the transmembrane domain is a CD8 transmembrane domain comprising the amino acid sequence set forth in SEQ ID NO: 101.

In some aspects, the disclosure provides a polynucleotide comprising an open reading frame (ORF) encoding a human interleukin-12 (IL-12) polypeptide operably linked to a membrane domain, optionally via a linker, wherein the human IL-12 polypeptide comprises an IL-12 p40 subunit (IL-12B) polypeptide operably linked to an IL-12 p35 subunit (IL-12A) polypeptide, wherein the membrane domain comprises a Platelet-Derived Growth Factor Receptor (PDGFR) transmembrane domain, and wherein the polynucleotide is an mRNA comprising a 5' untranslated region (UTR), the ORF, and a 3' UTR. In some aspects, the transmembrane domain is a PDGFR transmembrane domain comprising a PDGFR-beta transmembrane domain. In some embodiments, the PDGFR-beta transmembrane domain comprises the amino acid sequence set forth in SEQ ID NO: 102.

In some aspects, the disclosure provides a polynucleotide comprising an open reading frame (ORF) encoding a human interleukin-12 (IL-12) polypeptide operably linked to a membrane domain, optionally via a linker, wherein the human IL-12 polypeptide comprises an IL-12 p40 subunit (IL-12B) polypeptide operably linked to an IL-12 p35 subunit (IL-12A) polypeptide, wherein the membrane domain comprises a Cluster of Differentiation 80 (CD80) transmembrane domain, and wherein the polynucleotide is an mRNA comprising a 5' untranslated region (UTR), the ORF, and a 3' UTR. In some aspects, the transmembrane domain is a CD80 transmembrane domain comprising the amino acid sequence set forth in SEQ ID NO: 103.

In some aspects, the disclosure provides a polynucleotide comprising an open reading frame (ORF) encoding a human interleukin-12 (IL-12) polypeptide operably linked to a membrane domain, optionally via a linker, wherein the human IL-12 polypeptide comprises an IL-12 p40 subunit (IL-12B) polypeptide operably linked to an IL-12 p35 subunit (IL-12A) polypeptide, wherein the membrane domain comprises a transmembrane domain and an intracellular domain, and wherein the polynucleotide is an mRNA comprising a 5' untranslated region (UTR), the ORF, and a 3' UTR.

In some embodiments, the intracellular domain is derived from the same polypeptide as the transmembrane domain. In some embodiments, the intracellular domain is derived from a different polypeptide than the transmembrane domain is derived from. In some embodiments, the intracellular domain is selected from the group consisting of: a PDGFR intracellular domain, a truncated PDGFR intracellular domain, and a CD80 intracellular domain.

In some aspects, the intracellular domain is a PDGFR intracellular domain comprising a PDGFR-beta intracellular domain. In some embodiments, the PDGFR-beta intracellular domain comprises the amino acid sequence set forth in SEQ ID NO: 226. In some aspects, the truncated PDGFR intracellular domain comprises a PDGFR-beta intracellular domain truncated at E570 or G739. In some aspects, truncated PDGFR-beta intracellular domain truncated at E570 comprises the amino acid sequence set forth in SEQ ID NO: 227. In some aspects, the truncated PDGFR-beta transmembrane truncated at G739 comprises the amino acid sequence set forth in SEQ ID NO: 228.

In some aspects, the intracellular domain is a CD80 intracellular domain. In some aspects, the CD80 intracellular domain comprises the amino acid sequence set forth in SEQ ID NO: 225.

In any of the foregoing aspects, the membrane domain comprises a PDGFR-beta transmembrane domain and a PDGFR-beta intracellular domain. In any of the foregoing aspects, the membrane domain comprises a PDGFR-beta transmembrane domain and a truncated PDGFR-beta intracellular domain truncated at E570. In any of the foregoing aspects, the membrane domain comprises a PDGFR-beta transmembrane domain and a truncated PDGFR-beta intracellular domain truncated at G739. In any of the foregoing aspects, the membrane domain comprises a CD80 transmembrane domain and a CD80 intracellular domain.

In some aspects, the disclosure provides a polynucleotide comprising an open reading frame (ORF) encoding a human interleukin-12 (IL-12) polypeptide operably linked to a membrane domain, optionally via a linker, wherein the human IL-12 polypeptide comprises an IL-12 p40 subunit (IL-12B) polypeptide operably linked to an IL-12 p35 subunit (IL-12A) polypeptide, wherein the membrane domain comprises a Platelet-Derived Growth Factor Receptor (PDGFR) transmembrane domain and a PDGFR intracellular domain, and wherein the polynucleotide is an mRNA comprising a 5' untranslated region (UTR), the ORF, and a 3' UTR. In some aspects, the PDGFR transmembrane domain comprises a PDGFR-beta transmembrane domain and the PDGFR intracellular domain comprises a PDGFR-beta intracellular domain. In some aspects, the PDGFR transmembrane domain comprises a PDGFR-beta transmembrane domain and the PDGFR intracellular domain comprises a truncated PDGFR-beta intracellular domain. In some embodiments, the PDGFR-beta transmembrane domain comprises the amino acid sequence set forth in SEQ ID NO: 102 and the PDGFR-beta intracellular domain comprises the amino acid sequence set forth in SEQ ID NO: 226. In some embodiments, the PDGFR-beta transmembrane domain comprises the amino acid sequence set forth in SEQ ID NO: 102 and the truncated PDGFR-beta intracellular domain comprises the amino acid sequence set forth in SEQ ID NO: 227. In some embodiments, the PDGFR-beta transmembrane domain comprises the amino acid sequence set forth in SEQ ID NO: 102 and the truncated PDGFR-beta intracellular domain comprises the amino acid sequence set forth in SEQ ID NO: 228.

In some aspects, the disclosure provides a polynucleotide comprising an open reading frame (ORF) encoding a human interleukin-12 (IL-12) polypeptide operably linked to a membrane domain, optionally via a linker, wherein the human IL-12 polypeptide comprises an IL-12 p40 subunit (IL-12B) polypeptide operably linked to an IL-12 p35 subunit (IL-12A) polypeptide, wherein the membrane domain comprises a Cluster of Differentiation 80 (CD80) transmembrane domain and a CD80 intracellular domain, and wherein the polynucleotide is an mRNA comprising a 5' untranslated region (UTR), the ORF, and a 3' UTR. In some aspects, the CD80 transmembrane domain comprises the amino acid sequence set forth in SEQ ID NO: 103 and the CD80 intracellular domain comprises the amino acid sequence set forth in SEQ ID NO: 225.

In any of the foregoing aspects, the membrane domain is operably linked to the IL-12A polypeptide by a peptide linker. In any of the foregoing aspects, the membrane domain is operably linked to the IL-12B polypeptide by a peptide linker.

In some aspects, the membrane domain is operably linked to the IL-12A polypeptide by a Gly/Ser linker. In some aspects, the membrane domain is operably linked to the IL-12B polypeptide by a Gly/Ser linker.

In some aspects, the Gly/Ser linker comprises $(G_nS)_m$, wherein n is 1, 2 3, 4, 5, 6, 7, 8, 9, 10, 15, or 20 and m is 1, 2, 3, 4, 5, 6, 7, 8, 9, 10, 15, or 20. In some aspects, the Gly/Ser linker further comprises a leucine and a glutamine at the 3'end of the Gly/Ser linker. In some aspects, the linker comprises the amino acid sequence set forth in SEQ ID NO: 229.

In any of the foregoing aspects, the IL-12B polypeptide is operably linked to the IL-12A polypeptide by a peptide linker. In some aspects, the IL-12B polypeptide is located at the 5' terminus of the IL-12A polypeptide, or the 5' terminus of the peptide linker. In some aspects, the IL-12A polypeptide is located at the 5' terminus of the IL-12B polypeptide, or the 5' terminus of the peptide linker. In some aspects, the peptide linker comprises a Gly/Ser linker. In some aspects, the Gly/Ser linker comprises $(G_nS)_m$, wherein n is 1, 2 3, 4, 5, 6, 7, 8, 9, 10, 15, or 20 and m is 1, 2, 3, 4, 5, 6, 7, 8, 9, 10, 15, or 20. In some aspects, the Gly/Ser linker comprises $(G_nS)_m$, and wherein n is 6 and m is 1.

In any of the foregoing aspects, the ORF encodes a signal peptide. In some aspects, the signal peptide is an IL-12B signal peptide. In some aspects, the IL-12B signal peptide comprises the amino acid sequence set forth in amino acids 1 to 22 of SEQ ID NO: 48.

In any of the foregoing aspects, the IL-12B polypeptide comprises the amino acid sequence set forth in amino acids 23 to 328 of SEQ ID NO: 48. In any of the foregoing aspects, the IL-12A polypeptide comprises the amino acid sequence set forth in amino acids 336 to 532 of SEQ ID NO: 48.

In some aspects, the disclosure provides a polynucleotide comprising an open reading frame (ORF) encoding a human interleukin-12 (IL-12) polypeptide operably linked to a membrane domain via a linker, wherein the human IL-12 polypeptide comprises an IL-12 p40 subunit (IL-12B) polypeptide operably linked to an IL-12 p35 subunit (IL-12A)

polypeptide via a linker, wherein the membrane domain comprises a transmembrane domain, and wherein the polynucleotide is an mRNA comprising a 5' untranslated region (UTR), the ORF, and a 3' UTR.

In some aspects, the disclosure provides a polynucleotide comprising an open reading frame (ORF) encoding a human interleukin-12 (IL-12) polypeptide operably linked to a membrane domain via a linker, wherein the human IL-12 polypeptide comprises an IL-12 p40 subunit (IL-12B) polypeptide operably linked to an IL-12 p35 subunit (IL-12A) polypeptide via a linker, wherein the membrane domain comprises a transmembrane domain derived from a Type I integral membrane protein, and wherein the polynucleotide is an mRNA comprising a 5' untranslated region (UTR), the ORF, and a 3' UTR.

In some aspects, the transmembrane domain is selected from the group consisting of: a Cluster of Differentiation 8 (CD8) transmembrane domain, a Platelet-Derived Growth Factor Receptor (PDGFR) transmembrane domain, and a Cluster of Differentiation 80 (CD80) transmembrane domain.

In some aspects, the disclosure provides a polynucleotide comprising an open reading frame (ORF) encoding a human interleukin-12 (IL-12) polypeptide operably linked to a membrane domain via a linker, wherein the human IL-12 polypeptide comprises an IL-12 p40 subunit (IL-12B) polypeptide operably linked to an IL-12 p35 subunit (IL-12A) polypeptide via a linker, wherein the membrane domain comprises a Cluster of Differentiation 8 (CD8) transmembrane domain, and wherein the polynucleotide is an mRNA comprising a 5' untranslated region (UTR), the ORF, and a 3' UTR. In some aspects, the transmembrane domain is a CD8 transmembrane domain comprising the amino acid sequence set forth in SEQ ID NO: 101.

In some aspects, the disclosure provides a polynucleotide comprising an open reading frame (ORF) encoding a human interleukin-12 (IL-12) polypeptide operably linked to a membrane domain via a linker, wherein the human IL-12 polypeptide comprises an IL-12 p40 subunit (IL-12B) polypeptide operably linked to an IL-12 p35 subunit (IL-12A) polypeptide via a linker, wherein the membrane domain comprises a Platelet-Derived Growth Factor Receptor (PDGFR) transmembrane domain, and wherein the polynucleotide is an mRNA comprising a 5' untranslated region (UTR), the ORF, and a 3' UTR. In some aspects, the transmembrane domain is a PDGFR transmembrane domain comprising a PDGFR-beta transmembrane domain. In some embodiments, the PDGFR-beta transmembrane domain comprises the amino acid sequence set forth in SEQ ID NO: 102.

In some aspects, the disclosure provides a polynucleotide comprising an open reading frame (ORF) encoding a human interleukin-12 (IL-12) polypeptide operably linked to a membrane domain via a linker, wherein the human IL-12 polypeptide comprises an IL-12 p40 subunit (IL-12B) polypeptide operably linked to an IL-12 p35 subunit (IL-12A) polypeptide via a linker, wherein the membrane domain comprises a Cluster of Differentiation 80 (CD80) transmembrane domain, and wherein the polynucleotide is an mRNA comprising a 5' untranslated region (UTR), the ORF, and a 3' UTR. In some aspects, the transmembrane domain is a CD8 transmembrane domain comprising the amino acid sequence set forth in SEQ ID NO: 103.

In some aspects, the disclosure provides a polynucleotide comprising an open reading frame (ORF) encoding a human interleukin-12 (IL-12) polypeptide operably linked to a membrane domain via a linker, wherein the human IL-12 polypeptide comprises an IL-12 p40 subunit (IL-12B) polypeptide operably linked to an IL-12 p35 subunit (IL-12A) polypeptide via a linker, wherein the membrane domain comprises a Platelet-Derived Growth Factor Receptor (PDGFR) transmembrane domain and a PDGFR intracellular domain, and wherein the polynucleotide is an mRNA comprising a 5' untranslated region (UTR), the ORF, and a 3' UTR. In some aspects, the PDGFR transmembrane domain comprises a PDGFR-beta transmembrane domain and the PDGFR intracellular domain comprises a PDGFR-beta intracellular domain. In some aspects, the PDGFR transmembrane domain comprises a PDGFR-beta transmembrane domain and the PDGFR intracellular domain comprises a truncated PDGFR-beta intracellular domain. In some embodiments, the PDGFR-beta transmembrane domain comprises the amino acid sequence set forth in SEQ ID NO: 102 and the PDGFR-beta intracellular domain comprises the amino acid sequence set forth in SEQ ID NO: 226. In some embodiments, the PDGFR-beta transmembrane domain comprises the amino acid sequence set forth in SEQ ID NO: 102 and the truncated PDGFR-beta intracellular domain comprises the amino acid sequence set forth in SEQ ID NO: 227. In some embodiments, the PDGFR-beta transmembrane domain comprises the amino acid sequence set forth in SEQ ID NO: 102 and the truncated PDGFR-beta intracellular domain comprises the amino acid sequence set forth in SEQ ID NO: 228.

In some aspects, the disclosure provides a polynucleotide comprising an open reading frame (ORF) encoding a human interleukin-12 (IL-12) polypeptide operably linked to a membrane domain via a linker, wherein the human IL-12 polypeptide comprises an IL-12 p40 subunit (IL-12B) polypeptide operably linked to an IL-12 p35 subunit (IL-12A) polypeptide via a linker, wherein the membrane domain comprises a Cluster of Differentiation 80 (CD80) transmembrane domain and a CD80 intracellular domain, and wherein the polynucleotide is an mRNA comprising a 5' untranslated region (UTR), the ORF, and a 3' UTR. In some aspects, the CD80 transmembrane domain comprises the amino acid sequence set forth in SEQ ID NO: 103 and the CD80 intracellular domain comprises the amino acid sequence set forth in SEQ ID NO: 225.

In some aspects, the disclosure provides an mRNA comprising a 5' UTR, an open reading frame (ORF), and a 3' UTR, wherein the ORF comprises a nucleotide sequence encoding from 5' to 3':

5'-[IL-12B]-[L1]-[IL-12A]-[L2]-[MD]-3', wherein

IL-12B is a human IL-12 p40 subunit polypeptide,

L1 is a first peptide linker,

IL-12A is a human IL-12 p35 subunit polypeptide,

L2 is a second peptide linker,

MD is a membrane domain comprising a transmembrane domain from a Type I integral membrane protein. In some aspects, the Type I integral membrane protein is selected from the group consisting of: a Cluster of Differentiation 8 (CD8) transmembrane domain, a Platelet-Derived Growth Factor Receptor (PDGFR) transmembrane domain, and a Cluster of Differentiation 80 (CD80) transmembrane domain.

In some aspects, the disclosure provides an mRNA comprising a 5' UTR, an open reading frame (ORF), and a 3' UTR, wherein the ORF comprises a nucleotide sequence encoding from 5' to 3':

5'-[IL-12B]-[L1]-[IL-12A]-[L2]-[MD]-3', wherein

IL-12B is a human IL-12 p40 subunit polypeptide,

L1 is a first peptide linker,

IL-12A is a human IL-12 p35 subunit polypeptide,

L2 is a second peptide linker,

MD is a membrane domain comprising a transmembrane domain from a Type I integral membrane protein, wherein the Type I integral membrane protein is selected from the group consisting of: a Cluster of Differentiation 8 (CD8) transmembrane domain, a Platelet-Derived Growth Factor Receptor (PDGFR) transmembrane domain, and a Cluster of Differentiation 80 (CD80) transmembrane domain.

In some aspects, the disclosure provides an mRNA comprising a 5' UTR, an open reading frame (ORF), and a 3' UTR, wherein the ORF comprises a nucleotide sequence encoding from 5' to 3':

5'-[IL-12B]-[L1]-[IL-12A]-[L2]-[MD]-3', wherein
IL-12B is a human IL-12 p40 subunit polypeptide,
L1 is a first peptide linker,
IL-12A is a human IL-12 p35 subunit polypeptide,
L2 is a second peptide linker,
MD is a membrane domain comprising a transmembrane domain from a Type I integral membrane protein and an intracellular domain. In some aspects, the Type I integral membrane protein is selected from the group consisting of: a Cluster of Differentiation 8 (CD8) transmembrane domain, a Platelet-Derived Growth Factor Receptor (PDGFR) transmembrane domain, and a Cluster of Differentiation 80 (CD80) transmembrane domain.

In some aspects, the disclosure provides an mRNA comprising a 5' UTR, an open reading frame (ORF), and a 3' UTR, wherein the ORF comprises a nucleotide sequence encoding from 5' to 3':

5'-[IL-12B]-[L1]-[IL-12A]-[L2]-[MD]-3', wherein
IL-12B is a human IL-12 p40 subunit polypeptide,
L1 is a first peptide linker,
IL-12A is a human IL-12 p35 subunit polypeptide,
L2 is a second peptide linker,
MD is a membrane domain comprising a transmembrane domain from a Type I integral membrane protein and an intracellular domain, wherein the Type I integral membrane protein is selected from the group consisting of: a Cluster of Differentiation 8 (CD8) transmembrane domain, a Platelet-Derived Growth Factor Receptor (PDGFR) transmembrane domain, and a Cluster of Differentiation 80 (CD80) transmembrane domain.

In some aspects, the disclosure provides an mRNA comprising a 5' UTR, an open reading frame (ORF), and a 3' UTR, wherein the ORF comprises a nucleotide sequence encoding from 5' to 3':

5'-[IL-12B]-[L1]-[IL-12A]-[L2]-[MD]-3', wherein
IL-12B is a human IL-12 p40 subunit polypeptide,
L1 is a first peptide linker,
IL-12A is a human IL-12 p35 subunit polypeptide,
L2 is a second peptide linker,
MD is a membrane domain comprising a Cluster of Differentiation Factor 80 (CD80) transmembrane domain. In some aspects, the CD80 transmembrane domain comprises the amino acid sequence set forth in SEQ ID NO: 103.

In some aspects, the disclosure provides an mRNA comprising a 5' UTR, an open reading frame (ORF), and a 3' UTR, wherein the ORF comprises a nucleotide sequence encoding from 5' to 3':

5'-[IL-12B]-[L1]-[IL-12A]-[L2]-[MD]-3', wherein
IL-12B is a human IL-12 p40 subunit polypeptide,
L1 is a first peptide linker,
IL-12A is a human IL-12 p35 subunit polypeptide,
L2 is a second peptide linker,
MD is a membrane domain comprising a Cluster of Differentiation Factor 80 (CD80) transmembrane domain and a CD80 intracellular domain. In some aspects, the CD80 transmembrane domain comprises the amino acid sequence set forth in SEQ ID NO: 103. In some aspects, the CD80 intracellular domain comprises the amino acid sequence set forth in SEQ ID NO: 225. In some aspects, the MD comprises a CD80 transmembrane domain comprising the amino acid sequence set forth in SEQ ID NO: 103, and a CD80 intracellular domain comprising the amino acid sequence set forth in SEQ ID NO: 225.

In some aspects, the disclosure provides an mRNA comprising a 5' UTR, an open reading frame (ORF), and a 3' UTR, wherein the ORF comprises a nucleotide sequence encoding from 5' to 3':

5'-[IL-12B]-[L1]-[IL-12A]-[L2]-[MD]-3', wherein
IL-12B is a human IL-12 p40 subunit polypeptide,
L1 is a first peptide linker,
IL-12A is a human IL-12 p35 subunit polypeptide,
L2 is a second peptide linker,
MD is a membrane domain comprising a PDGFR transmembrane domain. In some aspects, the PDGFR transmembrane domain comprises a PDGFR-beta transmembrane domain. In some aspects, the PDGFR-beta transmembrane domain comprises the amino acid sequence set forth in SEQ ID NO: 102.

In some aspects, the disclosure provides an mRNA comprising a 5' UTR, an open reading frame (ORF), and a 3' UTR, wherein the ORF comprises a nucleotide sequence encoding from 5' to 3':

5'-[IL-12B]-[L1]-[IL-12A]-[L2]-[MD]-3', wherein
IL-12B is a human IL-12 p40 subunit polypeptide,
L1 is a first peptide linker,
IL-12A is a human IL-12 p35 subunit polypeptide,
L2 is a second peptide linker,
MD is a membrane domain comprising a PDGFR transmembrane domain and a PDGFR intracellular domain. In some aspects, the PDGFR transmembrane domain comprises a PDGFR-beta transmembrane domain. In some aspects, the PDGFR-beta transmembrane domain comprises the amino acid sequence set forth in SEQ ID NO: 102. In some aspects, the PDGFR intracellular domain comprises a PDGFR-beta intracellular domain. In some aspects, the PDGFR-beta intracellular domain comprises the amino acid sequence set forth in SEQ ID NO: 226. In some aspects, the PDGFR intracellular domain comprises a truncated PDGFR-beta intracellular domain. In some aspects, the truncated PDGFR-beta intracellular domain is truncated at E570 and comprises the amino acid sequence set forth in SEQ ID NO: 227. In some aspects, the truncated PDGFR-beta intracellular domain is truncated at G739 and comprises the amino acid sequence set forth in SEQ ID NO: 228. In some aspects, the MD comprises a PDGFR-beta transmembrane domain comprising the amino acid sequence set forth in SEQ ID NO: 102, and a PDGFR-beta intracellular domain comprising the amino acid sequence set forth in SEQ ID NO: 226. In some aspects, the MD comprises a PDGFR-beta transmembrane domain comprising the amino acid sequence set forth in SEQ ID NO: 102, and a truncated PDGFR-beta intracellular domain comprising the amino acid sequence set forth in SEQ ID NO: 227. In some aspects, the MD comprises a PDGFR-beta transmembrane domain comprising the amino acid sequence set forth in SEQ ID NO: 102, and a truncated PDGFR-beta intracellular domain comprising the amino acid sequence set forth in SEQ ID NO: 228.

In any of the foregoing aspects, the ORF of the mRNA encodes a signal peptide. In some aspects, the signal peptide is an IL-12B signal peptide. In some aspects, the IL-12B signal peptide comprises the amino acid sequence set forth in amino acids 1 to 22 of SEQ ID NO: 48.

In any of the foregoing aspects, the ORF of the mRNA encodes an IL-12B polypeptide comprising the amino acid sequence set forth in amino acids 23 to 328 of SEQ ID NO: 48.

In any of the foregoing aspects, the ORF of the mRNA encodes an IL-12B polypeptide comprising the amino acid sequence set forth in amino acids 336 to 532 of SEQ ID NO: 48.

In any of the foregoing aspects, first peptide linker [L1] and second peptide linker [L2] are each a Gly/Ser linker. In some aspects, [L1] comprises SEQ ID NO: 214. In some aspects, [L2] comprises $(G_nS)_m$, wherein n is 1-4, 1, 2, 3 or 4 and m is 1-4, 1, 2, 3, or 4. In some aspects, [L2] comprises $(G_4S)_m$, wherein m is 1-4, 1, 2, 3, or 4. In some aspects, [L2] comprises the amino acid sequence set forth in SEQ ID NO: 229.

In any of the foregoing aspects, the ORF of the mRNA comprises the sequence set forth in SEQ ID NO: 273 or SEQ ID NO: 274, or a nucleotide sequence at least 90%, at least 95%, at least 97%, at least 98% or at least 99% identical to a sequence set forth in SEQ ID NO: 273 or SEQ ID NO: 274.

In any of the foregoing aspects, the ORF of the mRNA comprises the sequence set forth in any one of SEQ ID NOs: 275-279, or a nucleotide sequence at least 90%, at least 95%, at least 97%, at least 98% or at least 99% identical to a sequence set forth in any one of SEQ ID NOs: 275-279.

In any of the foregoing aspects, the ORF of the mRNA comprises the sequence set forth in SEQ ID NO: 281, or a nucleotide sequence at least 90%, at least 95%, at least 97%, at least 98% or at least 99% identical to a sequence set forth in SEQ ID NO: 281.

In any of the foregoing aspects, the ORF of the mRNA comprises the sequence set forth in SEQ ID NO: 282, or a nucleotide sequence at least 90%, at least 95%, at least 97%, at least 98% or at least 99% identical to a sequence set forth in SEQ ID NO: 282.

In any of the foregoing aspects, the 3'UTR of the polynucleotide or mRNA comprises a microRNA binding site. In some aspects, the microRNA binding site is a miR-122 binding site. In some aspects, the miR-122 binding site is a miR-122-3p or miR-122-5p binding site. In some aspects, the miR-122-5p binding site comprises the sequence set forth in SEQ ID NO: 54. In some aspects, the 3'UTR comprises a sequence set forth in SEQ ID NO: 283.

In any of the foregoing aspects, the 5'UTR of the polynucleotide or mRNA comprises a sequence set forth in SEQ ID NO: 287.

In any of the foregoing aspects, the polynucleotide or mRNA comprises a 5'terminal cap structure. In some aspects, the 5' terminal cap structure is a Cap0, Cap1, ARCA, inosine, N1-methyl-guanosine, 2'fluoro-guanosine, 7-deaza-guanosine, 8-oxo-guanosine, 2-amino-guanosine, LNA-guanosine, 2-azidoguanosine, Cap2, Cap4, 5'methyl-Gcap, or an analog thereof.

In any of the foregoing aspects, the polynucleotide or mRNA comprises a 3' polyA tail.

In any of the foregoing aspects, the polynucleotide or mRNA comprises at least one chemical modification. In some aspects, the chemical modification is selected from the group consisting of pseudouridine, N1-methylpseudouridine, 2-thiouridine, 4'-thiouridine, 5-methylcytosine, 2-thio-1-methyl-1-deaza-pseudouridine, 2-thio-1-methyl-pseudouridine, 2-thio-5-aza-uridine, 2-thio-dihydropseudouridine, 2-thio-dihydrouridine, 2-thio-pseudouridine, 4-methoxy-2-thio-pseudouridine, 4-methoxy-pseudouridine, 4-thio-1-methyl-pseudouridine, 4-thio-pseudouridine, 5-aza-uridine, dihydropseudouridine, 5-methyluridine, 5-methyluridine, 5-methoxyuridine, and 2'-O-methyl uridine. In some aspects, the chemical modification is selected from the group consisting of pseudouridine or a pseudouridine analog. In some aspects, the chemical modification is N1-methylpseudouridine. In some aspects, the mRNA is fully modified with N1-methylpseudouridine.

In some aspects, the disclosure provides a composition comprising a polynucleotide or mRNA as described herein, and a pharmaceutically acceptable carrier.

In some aspects, the disclosure provides a lipid nanoparticle comprising a polynucleotide or mRNA as described herein.

In some aspects, the disclosure provides a lipid nanoparticle comprising a polynucleotide comprising an open reading frame (ORF) encoding a human interleukin-12 (IL-12) polypeptide operably linked to a membrane domain, optionally via a linker, wherein the human IL-12 polypeptide comprises an IL-12 p40 subunit (IL-12B) polypeptide operably linked to an IL-12 p35 subunit (IL-12A) polypeptide, wherein the membrane domain comprises a transmembrane domain, and wherein the polynucleotide is an mRNA comprising a 5' untranslated region (UTR), the ORF, and a 3' UTR.

In some aspects, the disclosure provides a lipid nanoparticle comprising a polynucleotide comprising an open reading frame (ORF) encoding a human interleukin-12 (IL-12) polypeptide operably linked to a membrane domain, via a linker, wherein the human IL-12 polypeptide comprises an IL-12 p40 subunit (IL-12B) polypeptide operably linked to an IL-12 p35 subunit (IL-12A) polypeptide, wherein the membrane domain comprises a transmembrane domain and an intracellular domain, and wherein the polynucleotide is an mRNA comprising a 5' untranslated region (UTR), the ORF, and a 3' UTR.

In some aspects, the disclosure provides a lipid nanoparticle comprising a polynucleotide comprising an open reading frame (ORF) encoding a human interleukin-12 (IL-12) polypeptide operably linked to a membrane domain, via a linker, wherein the human IL-12 polypeptide comprises an IL-12 p40 subunit (IL-12B) polypeptide operably linked to an IL-12 p35 subunit (IL-12A) polypeptide, wherein the membrane domain comprises a Cluster of Differentiation 8 (CD8) transmembrane domain, and wherein the polynucleotide is an mRNA comprising a 5' untranslated region (UTR), the ORF, and a 3' UTR.

In some aspects, the disclosure provides a lipid nanoparticle comprising a polynucleotide comprising an open reading frame (ORF) encoding a human interleukin-12 (IL-12) polypeptide operably linked to a membrane domain, via a linker, wherein the human IL-12 polypeptide comprises an IL-12 p40 subunit (IL-12B) polypeptide operably linked to an IL-12 p35 subunit (IL-12A) polypeptide, wherein the membrane domain comprises a Platelet-Derived Growth Factor Receptor (PDGFR) transmembrane domain, and wherein the polynucleotide is an mRNA comprising a 5' untranslated region (UTR), the ORF, and a 3' UTR.

In some aspects, the disclosure provides a lipid nanoparticle comprising a polynucleotide comprising an open reading frame (ORF) encoding a human interleukin-12 (IL-12) polypeptide operably linked to a membrane domain, via a linker, wherein the human IL-12 polypeptide comprises an IL-12 p40 subunit (IL-12B) polypeptide operably linked to an IL-12 p35 subunit (IL-12A) polypeptide, wherein the membrane domain comprises a Cluster of Differentiation 80

(CD80) transmembrane domain, and wherein the polynucleotide is an mRNA comprising a 5' untranslated region (UTR), the ORF, and a 3' UTR.

In some aspects, the disclosure provides a lipid nanoparticle comprising a polynucleotide comprising an open reading frame (ORF) encoding a human interleukin-12 (IL-12) polypeptide operably linked to a membrane domain, optionally via a linker, wherein the human IL-12 polypeptide comprises an IL-12 p40 subunit (IL-12B) polypeptide operably linked to an IL-12 p35 subunit (IL-12A) polypeptide, wherein the membrane domain comprises a Platelet-Derived Growth Factor Receptor (PDGFR) transmembrane domain and a PDGFR intracellular domain, and wherein the polynucleotide is an mRNA comprising a 5' untranslated region (UTR), the ORF, and a 3' UTR.

In some aspects, the disclosure provides a lipid nanoparticle comprising a polynucleotide comprising an open reading frame (ORF) encoding a human interleukin-12 (IL-12) polypeptide operably linked to a membrane domain, optionally via a linker, wherein the human IL-12 polypeptide comprises an IL-12 p40 subunit (IL-12B) polypeptide operably linked to an IL-12 p35 subunit (IL-12A) polypeptide, wherein the membrane domain comprises a Cluster of Differentiation 80 (CD80) transmembrane domain and a CD80 intracellular domain, and wherein the polynucleotide is an mRNA comprising a 5' untranslated region (UTR), the ORF, and a 3' UTR.

In some aspects, the lipid nanoparticle comprises a molar ratio of about 20-60% ionizable amino lipid: 5-25% phospholipid: 25-55% sterol; and 0.5-15% PEG-modified lipid. In some aspects, the ionizable amino lipid is selected from the group consisting of for example, 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319). In some aspects, the ionizable amino lipid comprises a compound of Formula (I). In some aspects, the compound of Formula (I) is Compound 18.

In some aspects, the disclosure provides a lipid nanoparticle comprising a polynucleotide comprising an open reading frame (ORF) encoding a human interleukin-12 (IL-12) polypeptide operably linked to a membrane domain, optionally via a linker, wherein the human IL-12 polypeptide comprises an IL-12 p40 subunit (IL-12B) polypeptide operably linked to an IL-12 p35 subunit (IL-12A) polypeptide, wherein the membrane domain comprises a Cluster of Differentiation 80 (CD80) transmembrane domain and a CD80 intracellular domain, wherein the polynucleotide is an mRNA comprising a 5' untranslated region (UTR), the ORF, and a 3' UTR, and wherein the lipid nanoparticle comprising a molar ratio of about 20-60% ionizable amino lipid: 5-25% phospholipid: 25-55% sterol; and 0.5-15% PEG-modified lipid.

In some aspects, the disclosure provides a lipid nanoparticle comprising a polynucleotide comprising an open reading frame (ORF) encoding a human interleukin-12 (IL-12) polypeptide operably linked to a membrane domain, optionally via a linker, wherein the human IL-12 polypeptide comprises an IL-12 p40 subunit (IL-12B) polypeptide operably linked to an IL-12 p35 subunit (IL-12A) polypeptide, wherein the membrane domain comprises a Cluster of Differentiation 80 (CD80) transmembrane domain and a CD80 intracellular domain, wherein the polynucleotide is an mRNA comprising a 5' untranslated region (UTR), the ORF, and a 3' UTR, wherein the lipid nanoparticle comprising a molar ratio of about 20-60% ionizable amino lipid: 5-25% phospholipid: 25-55% sterol; and 0.5-15% PEG-modified lipid, and wherein the ionizable amino lipid is Compound 18.

In some aspects, the disclosure provides a pharmaceutical composition comprising a lipid nanoparticle as described herein, and a pharmaceutically acceptable carrier. In some aspects, the pharmaceutically acceptable carrier comprises a buffer solution. In some aspects, the pharmaceutical composition is formulated for intratumoral delivery.

In some aspects, the disclosure provides a polynucleotide, mRNA, composition, lipid nanoparticle, or pharmaceutical composition as described herein, for use in treating or delaying progression of cancer in an individual, wherein the treatment comprises administration of the polynucleotide, mRNA, composition, lipid nanoparticle or pharmaceutical composition in combination with a second composition, wherein the second composition comprises anti-cancer agent, or a polynucleotide comprising an ORF encoding an anti-cancer agent, such as a checkpoint inhibitor polypeptide, and an optional pharmaceutically acceptable carrier.

In some aspects, the disclosure provides a lipid nanoparticle comprising a polynucleotide comprising an open reading frame (ORF) encoding a human interleukin-12 (IL-12) polypeptide operably linked to a membrane domain, optionally via a linker, wherein the human IL-12 polypeptide comprises an IL-12 p40 subunit (IL-12B) polypeptide operably linked to an IL-12 p35 subunit (IL-12A) polypeptide, wherein the membrane domain comprises a transmembrane domain, and wherein the polynucleotide is an mRNA comprising a 5' untranslated region (UTR), the ORF, and a 3' UTR, for use in treating or delaying progression of cancer in an individual, wherein the treatment comprises administration of the lipid nanoparticle in combination with a second composition, wherein the second composition comprises anti-cancer agent, or a polynucleotide comprising an ORF encoding an anti-cancer agent, such as a checkpoint inhibitor polypeptide, and an optional pharmaceutically acceptable carrier.

In some aspects, the disclosure provides use of a polynucleotide, mRNA, composition, lipid nanoparticle, or pharmaceutical composition described herein in the manufacture of a medicament for treating or delaying progression of cancer in an individual, wherein the medicament comprises the polynucleotide, mRNA, composition, lipid nanoparticle, or pharmaceutical composition, and an optional pharmaceutically acceptable carrier, and wherein the treatment comprises administration of the medicament in combination with a composition comprising an anti-cancer agent, or a polynucleotide comprising an ORF encoding an anti-cancer agent, such as a checkpoint inhibitor polypeptide, and an optional pharmaceutically acceptable carrier.

In some aspects, the disclosure provides use of a lipid nanoparticle comprising a polynucleotide comprising an open reading frame (ORF) encoding a human interleukin-12 (IL-12) polypeptide operably linked to a membrane domain, optionally via a linker, wherein the human IL-12 polypeptide comprises an IL-12 p40 subunit (IL-12B) polypeptide operably linked to an IL-12 p35 subunit (IL-12A) polypeptide, wherein the membrane domain comprises a transmembrane domain, and wherein the polynucleotide is an mRNA comprising a 5' untranslated region (UTR), the ORF, and a 3' UTR, in the manufacture of a medicament for treating or delaying progression of cancer in an individual, wherein the medicament comprises the lipid nanoparticle and an optional pharmaceutically acceptable carrier, and wherein the treatment comprises administration of the medicament in combination with a composition comprising an anti-cancer agent, or a polynucleotide comprising an ORF encoding an anti-cancer agent, such as a checkpoint inhibitor polypeptide, and an optional pharmaceutically acceptable carrier.

In some aspects, the disclosure provides a kit comprising a container comprising a polynucleotide, mRNA, composition, the lipid nanoparticle, or pharmaceutical composition as described herein, and an optional pharmaceutically acceptable carrier, and a package insert comprising instructions for administration of the polynucleotide, mRNA, composition, lipid nanoparticle or pharmaceutical composition, for treating or delaying progression of cancer in an individual. In some aspects, the package insert further comprises instructions for administration of the lipid nanoparticle or pharmaceutical composition in combination with a composition comprising an anti-cancer agent, or a polynucleotide comprising an ORF encoding an anti-cancer agent, such as a checkpoint inhibitor polypeptide, and an optional pharmaceutically acceptable carrier, for treating or delaying progression of cancer in an individual.

In some aspects, the disclosure provides a kit comprising a container comprising a lipid nanoparticle comprising a polynucleotide comprising an open reading frame (ORF) encoding a human interleukin-12 (IL-12) polypeptide operably linked to a membrane domain, optionally via a linker, wherein the human IL-12 polypeptide comprises an IL-12 p40 subunit (IL-12B) polypeptide operably linked to an IL-12 p35 subunit (IL-12A) polypeptide, wherein the membrane domain comprises a transmembrane domain, and wherein the polynucleotide is an mRNA comprising a 5' untranslated region (UTR), the ORF, and a 3' UTR, and an optional pharmaceutically acceptable carrier, and a package insert comprising instructions for administration of the lipid nanoparticle or treating or delaying progression of cancer in an individual.

In some aspects, the disclosure provides a kit comprising a polynucleotide, mRNA, composition, the lipid nanoparticle, or pharmaceutical composition as described herein, and a package insert comprising instructions for administration of the medicament alone, or in combination with a composition comprising an anti-cancer agent, or a polynucleotide comprising an ORF encoding an anti-cancer agent, such as a checkpoint inhibitor polypeptide, and an optional pharmaceutically acceptable carrier, for treating or delaying progression of cancer in an individual. In some aspects, the kit further comprises a package insert comprising instructions for administration of the first medicament prior to, current with, or subsequent to administration of the second medicament for treating or delaying progression of cancer in an individual.

In some aspects, the disclosure provides a kit comprising a lipid nanoparticle comprising a polynucleotide comprising an open reading frame (ORF) encoding a human interleukin-12 (IL-12) polypeptide operably linked to a membrane domain, optionally via a linker, wherein the human IL-12 polypeptide comprises an IL-12 p40 subunit (IL-12B) polypeptide operably linked to an IL-12 p35 subunit (IL-12A) polypeptide, wherein the membrane domain comprises a transmembrane domain, and wherein the polynucleotide is an mRNA comprising a 5' untranslated region (UTR), the ORF, and a 3' UTR, and a package insert comprising instructions for administration of the medicament alone, or in combination with a composition comprising an anti-cancer agent, or a polynucleotide comprising an ORF encoding an anti-cancer agent, such as a checkpoint inhibitor polypeptide, and an optional pharmaceutically acceptable carrier, for treating or delaying progression of cancer in an individual.

In any of the foregoing aspects, the checkpoint inhibitor polypeptide inhibits PD1, PD-L1, CTLA4, or a combination thereof. In some aspects, the checkpoint inhibitor polypeptide is an antibody. In some aspects, the checkpoint inhibitor polypeptide is an antibody selected from an anti-CTLA4 antibody or antigen-binding fragment thereof that specifically binds CTLA4, an anti-PD1 antibody or antigen-binding fragment thereof that specifically binds PD1, an anti-PD-L1 antibody or antigen-binding fragment thereof that specifically binds PD-L1, and a combination thereof. In some aspects, the checkpoint inhibitor polypeptide is an anti-PD-L1 antibody selected from atezolizumab, avelumab, or durvalumab. In some aspects, the checkpoint inhibitor polypeptide is an anti-CTLA-4 antibody selected from tremelimumab or ipilimumab. In some aspects, the checkpoint inhibitor polypeptide is an anti-PD1 antibody selected from nivolumab or pembrolizumab.

In some aspects, the disclosure provides a method of reducing the size of a tumor or inhibiting growth of a tumor in a subject in need thereof, comprising administering to the subject an effective amount of a polynucleotide, mRNA, composition, lipid nanoparticle or pharmaceutical composition as described herein.

In some aspects, the disclosure provides a method of reducing the size of a tumor or inhibiting growth of a tumor in a subject in need thereof, comprising administering to the subject an effective amount of a lipid nanoparticle comprising a polynucleotide comprising an open reading frame (ORF) encoding a human interleukin-12 (IL-12) polypeptide operably linked to a membrane domain, optionally via a linker, wherein the human IL-12 polypeptide comprises an IL-12 p40 subunit (IL-12B) polypeptide operably linked to an IL-12 p35 subunit (IL-12A) polypeptide, wherein the membrane domain comprises a transmembrane domain, and wherein the polynucleotide is an mRNA comprising a 5' untranslated region (UTR), the ORF, and a 3' UTR.

In some aspects, the disclosure provides a method of reducing the size of a tumor or inhibiting growth of a tumor in a subject in need thereof, comprising administering to the subject an effective amount of a lipid nanoparticle comprising a polynucleotide comprising an open reading frame (ORF) encoding a human interleukin-12 (IL-12) polypeptide operably linked to a membrane domain, via a linker, wherein the human IL-12 polypeptide comprises an IL-12 p40 subunit (IL-12B) polypeptide operably linked to an IL-12 p35 subunit (IL-12A) polypeptide, wherein the membrane domain comprises a transmembrane domain and an intracellular domain, and wherein the polynucleotide is an mRNA comprising a 5' untranslated region (UTR), the ORF, and a 3' UTR.

In some aspects, the disclosure provides a method of reducing the size of a tumor or inhibiting growth of a tumor in a subject in need thereof, comprising administering to the subject an effective amount of a lipid nanoparticle comprising a polynucleotide comprising an open reading frame (ORF) encoding a human interleukin-12 (IL-12) polypeptide operably linked to a membrane domain, via a linker, wherein the human IL-12 polypeptide comprises an IL-12 p40 subunit (IL-12B) polypeptide operably linked to an IL-12 p35 subunit (IL-12A) polypeptide, wherein the membrane domain comprises a CD80 transmembrane domain, and wherein the polynucleotide is an mRNA comprising a 5' untranslated region (UTR), the ORF, and a 3' UTR.

In some aspects, the disclosure provides a method of reducing the size of a tumor or inhibiting growth of a tumor in a subject in need thereof, comprising administering to the subject an effective amount of a lipid nanoparticle comprising a polynucleotide comprising an open reading frame (ORF) encoding a human interleukin-12 (IL-12) polypeptide operably linked to a membrane domain, via a linker, wherein the human IL-12 polypeptide comprises an IL-12 p40 subunit (IL-12B) polypeptide operably linked to an IL-12 p35 subunit (IL-12A) polypeptide, wherein the membrane domain comprises a PDGFR transmembrane domain, and wherein the polynucleotide is an mRNA comprising a 5' untranslated region (UTR), the ORF, and a 3' UTR.

In some aspects, the disclosure provides a method of reducing the size of a tumor or inhibiting growth of a tumor in a subject in need thereof, comprising administering to the subject an effective amount of a lipid nanoparticle comprising a polynucleotide comprising an open reading frame (ORF) encoding a human interleukin-12 (IL-12) polypeptide operably linked to a membrane domain, via a linker, wherein the human IL-12 polypeptide comprises an IL-12 p40 subunit (IL-12B) polypeptide operably linked to an IL-12 p35 subunit (IL-12A) polypeptide, wherein the membrane domain comprises a CD8 transmembrane domain, and wherein the polynucleotide is an mRNA comprising a 5' untranslated region (UTR), the ORF, and a 3' UTR.

In some aspects, the disclosure provides a method of reducing the size of a tumor or inhibiting growth of a tumor in a subject in need thereof, comprising administering to the subject an effective amount of a lipid nanoparticle comprising a polynucleotide comprising an open reading frame (ORF) encoding a human interleukin-12 (IL-12) polypeptide operably linked to a membrane domain, via a linker, wherein the human IL-12 polypeptide comprises an IL-12 p40 subunit (IL-12B) polypeptide operably linked to an IL-12 p35 subunit (IL-12A) polypeptide, wherein the membrane domain comprises a PDGFR transmembrane domain and a PDGFR intracellular domain, and wherein the polynucleotide is an mRNA comprising a 5' untranslated region (UTR), the ORF, and a 3' UTR.

In some aspects, the disclosure provides a method of reducing the size of a tumor or inhibiting growth of a tumor in a subject in need thereof, comprising administering to the subject an effective amount of a lipid nanoparticle comprising a polynucleotide comprising an open reading frame (ORF) encoding a human interleukin-12 (IL-12) polypeptide operably linked to a membrane domain, via a linker, wherein the human IL-12 polypeptide comprises an IL-12 p40 subunit (IL-12B) polypeptide operably linked to an IL-12 p35 subunit (IL-12A) polypeptide, wherein the membrane domain comprises a CD80 transmembrane domain and a CD80 intracellular domain, and wherein the polynucleotide is an mRNA comprising a 5' untranslated region (UTR), the ORF, and a 3' UTR.

In some aspects, the disclosure provides a method of inducing an anti-tumor response in a subject in need thereof, comprising administering to the subject an effective amount of a polynucleotide, mRNA, composition, lipid nanoparticle or pharmaceutical composition as described herein.

In some aspects, the disclosure provides a method of inducing an anti-tumor response in a subject in need thereof, comprising administering to the subject an effective amount of a lipid nanoparticle comprising a polynucleotide comprising an open reading frame (ORF) encoding a human interleukin-12 (IL-12) polypeptide operably linked to a membrane domain, optionally via a linker, wherein the human IL-12 polypeptide comprises an IL-12 p40 subunit (IL-12B) polypeptide operably linked to an IL-12 p35 subunit (IL-12A) polypeptide, wherein the membrane domain comprises a transmembrane domain, and wherein the polynucleotide is an mRNA comprising a 5' untranslated region (UTR), the ORF, and a 3' UTR.

In some aspects, the disclosure provides a method of inducing an anti-tumor response in a subject in need thereof, comprising administering to the subject an effective amount of a lipid nanoparticle comprising a polynucleotide comprising an open reading frame (ORF) encoding a human interleukin-12 (IL-12) polypeptide operably linked to a membrane domain, via a linker, wherein the human IL-12 polypeptide comprises an IL-12 p40 subunit (IL-12B) polypeptide operably linked to an IL-12 p35 subunit (IL-12A) polypeptide, wherein the membrane domain comprises a transmembrane domain and an intracellular domain, and wherein the polynucleotide is an mRNA comprising a 5' untranslated region (UTR), the ORF, and a 3' UTR.

In some aspects, the disclosure provides a method of inducing an anti-tumor response in a subject in need thereof, comprising administering to the subject an effective amount of a lipid nanoparticle comprising a polynucleotide comprising an open reading frame (ORF) encoding a human interleukin-12 (IL-12) polypeptide operably linked to a membrane domain, via a linker, wherein the human IL-12 polypeptide comprises an IL-12 p40 subunit (IL-12B) polypeptide operably linked to an IL-12 p35 subunit (IL-12A) polypeptide, wherein the membrane domain comprises a PDGFR transmembrane domain, and wherein the polynucleotide is an mRNA comprising a 5' untranslated region (UTR), the ORF, and a 3' UTR.

In some aspects, the disclosure provides a method of inducing an anti-tumor response in a subject in need thereof, comprising administering to the subject an effective amount of a lipid nanoparticle comprising a polynucleotide comprising an open reading frame (ORF) encoding a human interleukin-12 (IL-12) polypeptide operably linked to a membrane domain, via a linker, wherein the human IL-12 polypeptide comprises an IL-12 p40 subunit (IL-12B) polypeptide operably linked to an IL-12 p35 subunit (IL-12A) polypeptide, wherein the membrane domain comprises a CD80 transmembrane domain, and wherein the polynucleotide is an mRNA comprising a 5' untranslated region (UTR), the ORF, and a 3' UTR.

In some aspects, the disclosure provides a method of inducing an anti-tumor response in a subject in need thereof, comprising administering to the subject an effective amount of a lipid nanoparticle comprising a polynucleotide comprising an open reading frame (ORF) encoding a human interleukin-12 (IL-12) polypeptide operably linked to a membrane domain, via a linker, wherein the human IL-12 polypeptide comprises an IL-12 p40 subunit (IL-12B) polypeptide operably linked to an IL-12 p35 subunit (IL-12A) polypeptide, wherein the membrane domain comprises a CD8 transmembrane domain, and wherein the polynucleotide is an mRNA comprising a 5' untranslated region (UTR), the ORF, and a 3' UTR.

In some aspects, the disclosure provides a method of inducing an anti-tumor response in a subject in need thereof, comprising administering to the subject an effective amount of a lipid nanoparticle comprising a polynucleotide comprising an open reading frame (ORF) encoding a human interleukin-12 (IL-12) polypeptide operably linked to a membrane domain, via a linker, wherein the human IL-12 polypeptide comprises an IL-12 p40 subunit (IL-12B) polypeptide operably linked to an IL-12 p35 subunit (IL-12A) polypeptide, wherein the membrane domain comprises a CD80 transmembrane domain and a CD80 intracellular domain, and wherein the polynucleotide is an mRNA comprising a 5' untranslated region (UTR), the ORF, and a 3' UTR.

In some aspects, the disclosure provides a method of inducing an anti-tumor response in a subject in need thereof, comprising administering to the subject an effective amount of a lipid nanoparticle comprising a polynucleotide comprising an open reading frame (ORF) encoding a human interleukin-12 (IL-12) polypeptide operably linked to a membrane domain, via a linker, wherein the human IL-12 polypeptide comprises an IL-12 p40 subunit (IL-12B) polypeptide operably linked to an IL-12 p35 subunit (IL-12A) polypeptide, wherein the membrane domain comprises a PDGFR transmembrane domain and a PDGFR intracellular domain, and wherein the polynucleotide is an mRNA comprising a 5' untranslated region (UTR), the ORF, and a 3' UTR.

In any of the foregoing methods, the polynucleotide, mRNA, composition, lipid nanoparticle lipid or pharmaceutical composition is administered by intratumoral injection.

In any of the foregoing methods, the anti-tumor response comprises a T-cell response. In some aspects, the T-cell response comprises CD8+ T cells.

In any of the foregoing aspects, the method further comprises administering to the subject an effective amount of a composition comprising an anti-cancer agent, or a polynucleotide comprising an ORF encoding an anti-cancer agent.

In any of the foregoing aspects, the method further comprises administering a second composition comprising a checkpoint inhibitor polypeptide or polynucleotide encoding the same, and an optional pharmaceutically acceptable carrier. In some aspects, the checkpoint inhibitor polypeptide inhibits PD1, PD-L1, CTLA4, or a combination thereof. In some aspects, the checkpoint inhibitor polypeptide is an antibody. In some aspects, the checkpoint inhibitor polypeptide is an antibody selected from an anti-CTLA4 antibody or antigen-binding fragment thereof that specifically binds CTLA4, an anti-PD1 antibody or antigen-binding fragment thereof that specifically binds PD1, an anti-PD-L1 antibody or antigen-binding fragment thereof that specifically binds PD-L1, and a combination thereof. In some aspects, the checkpoint inhibitor polypeptide is an anti-PD-L1 antibody selected from atezolizumab, avelumab, or durvalumab. In some aspects, the checkpoint inhibitor polypeptide is an anti-CTLA-4 antibody selected from tremelimumab or ipilimumab. In some aspects, the checkpoint inhibitor polypeptide is an anti-PD1 antibody selected from nivolumab or pembrolizumab.

In any of the foregoing aspects, the composition comprising the checkpoint inhibitor polypeptide is administered by intravenous injection. In some aspects, the composition comprising the checkpoint inhibitor polypeptide is administered once every 2 to 3 weeks.

In any of the foregoing aspects, the second composition comprising the checkpoint inhibitor polypeptide is administered prior to, concurrent with, or subsequent to administration of the polynucleotide, mRNA, composition, lipid nanoparticle or pharmaceutical composition.

BRIEF DESCRIPTION OF THE DRAWINGS/FIGURES

FIGS. 1A-1D show exemplary structures of tethered IL-12 polypeptides with (FIGS. 1A and 1C) or without (FIGS. 1B and 1D) a linker between an IL-12 polypeptide ("IL12") and a membrane domain ("MD"). The "IL12" polypeptide includes polypeptides comprising IL-12A, IL-12B, or both IL-12A and IL-12B. "N" indicates the amino-terminus of the polypeptide, while "C" indicates the carboxy-terminus of the polypeptide.

Figure 2A:
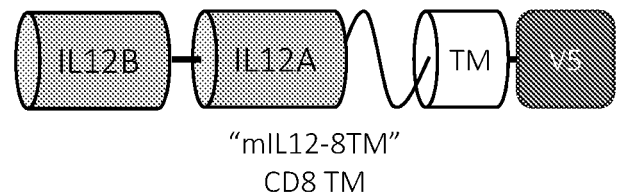
Figure 2B:
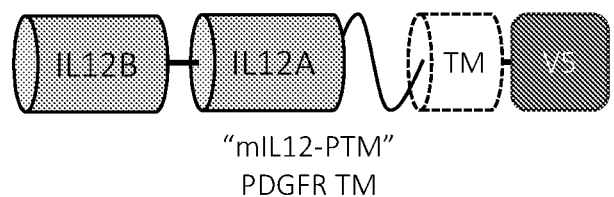
Figure 2C:
Figure 2D:
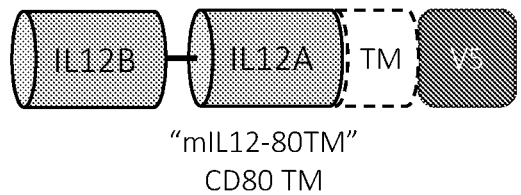
Figure 2E:
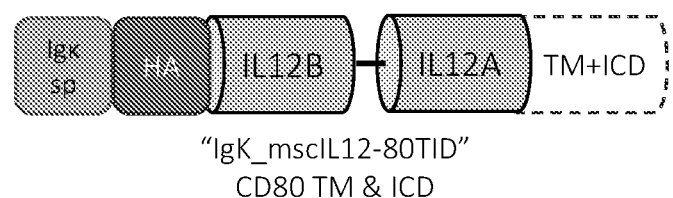

FIGS. 2A-2E show structures of tethered murine IL-12 polypeptides, comprising an IL-12B subunit linked to an IL-12A subunit via a linker, as used in the Examples. FIG. 2A shows an IL-12 polypeptide linked to a CD8 transmembrane domain via a linker, with a V5 tag ("mIL12-8TM"). FIG. 2B shows an IL-12 polypeptide linked to a PGFRB transmembrane domain via a linker, with a V5 tag ("mIL12-PTM"). FIG. 2C shows an IL-12 polypeptide linked to a CD80 transmembrane domain and intracellular domain via a linker ("mIL12-80TID"). FIG. 2D shows an IL-12 polypeptide linked to a CD80 transmembrane domain, with no linker, and a V5 tag ("mIL12-80TM"). FIG. 2E shows an IL-12 polypeptide linked to a CD80 transmembrane and intracellular domain without a linker, and comprising a hemagglutinin (HA) tag and IgK signal peptide ("IgK_ms-cIL12-80TID").

Figure 3:
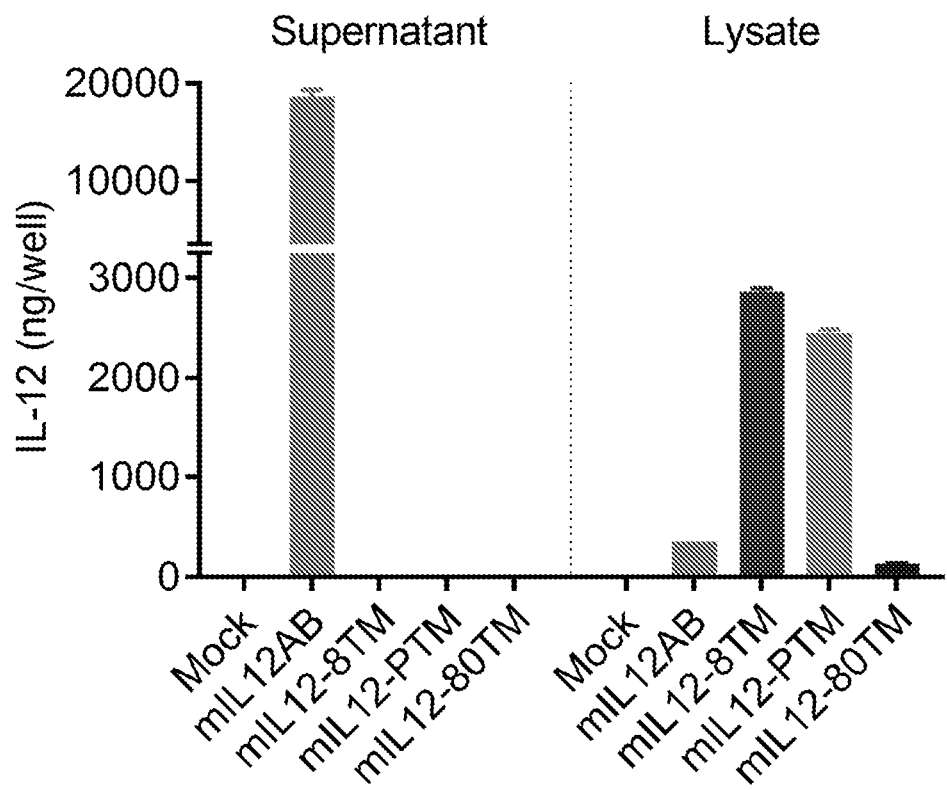

FIG. 3 is a graph depicting in vitro expression levels of IL-12 in the supernatant or lysates of HeLa cells after 24 hours of exposure to transfection reagent with no mRNA ("Mock") or transfected in individual cell culture wells with the following constructs: mRNA encoding a secreted mouse IL-12 polypeptide ("mIL12AB"), mIL12-8TM, mIL12-PTM, and mIL12-80TM. The amount of IL-12 in nanograms per respective culture well ("ng/well") is shown on the y-axis of the figure.

Figure 4A:
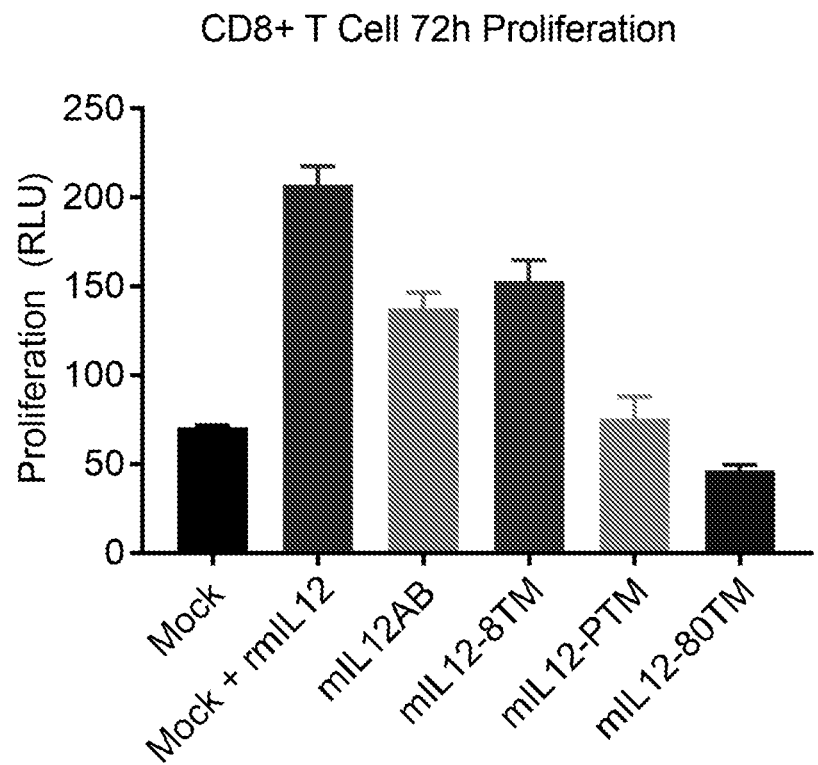
Figure 4B:
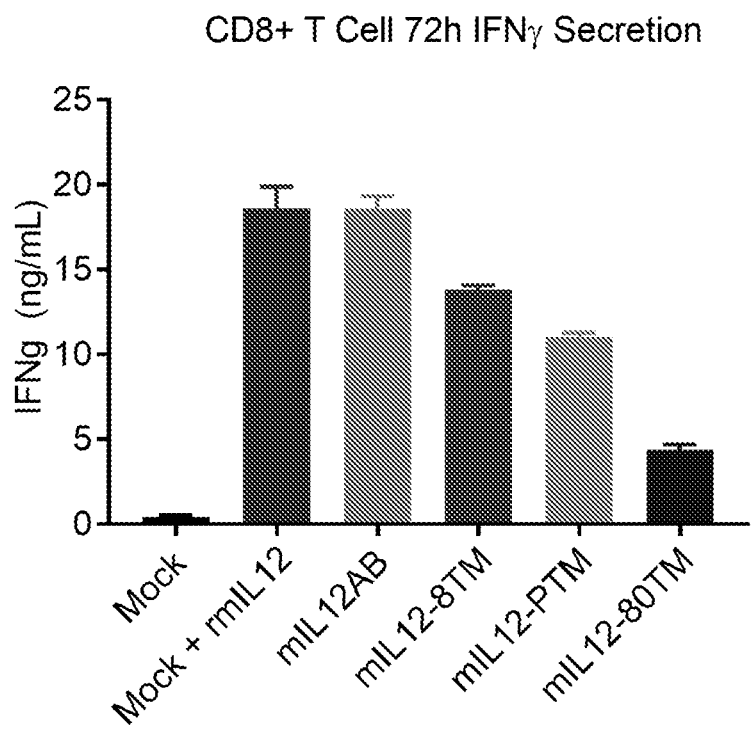
Figure 4C:
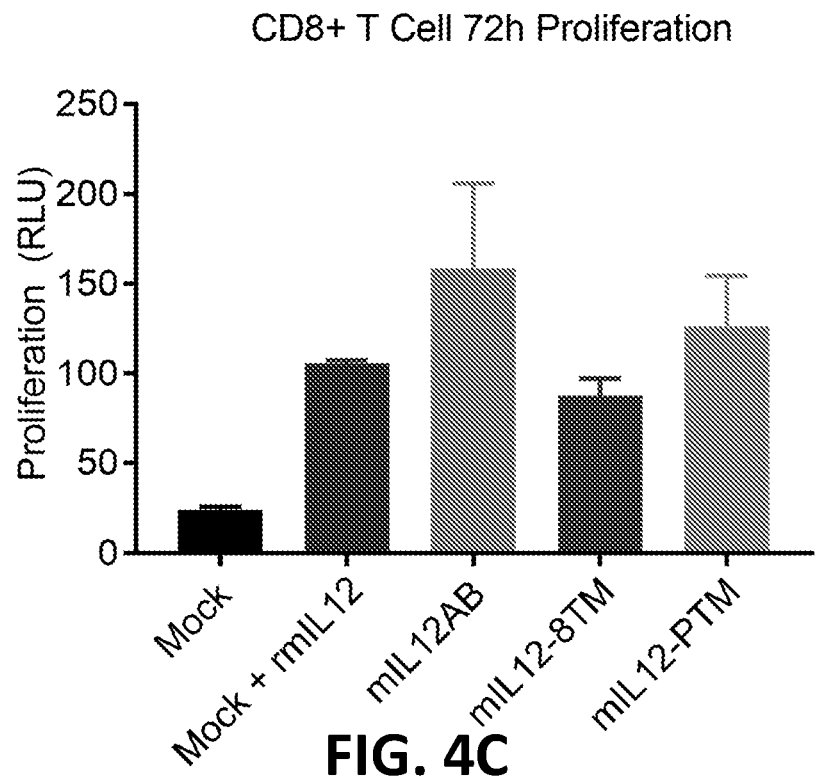
Figure 4D:
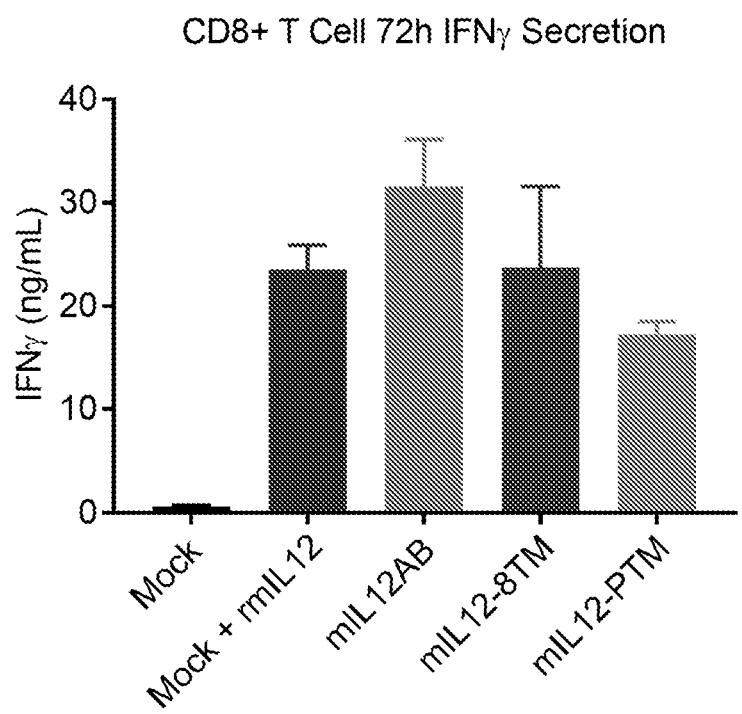

FIGS. 4A-4D show the in vitro bioactivity associated with various tethered IL-12 polypeptide constructs. FIGS. 4A and 4C show the level of proliferation of mouse splenic CD8+ T cell in relative light units ("RLU") on the y-axis. FIGS. 4B and 4D show the amount of interferon gamma (IFNγ) secretion by mouse splenic CD8+ T cells in nanograms per milliliter ("ng/ml") on the y-axis. Proliferation of and secretion by CD8+ T cells in each of FIGS. 4A-4D was measured after 72 hours in co-culture with "Mock" transfected HeLa cells or HeLa cells transfected in individual culture wells with mIL12AB, mIL12-8TM, or mIL12-80TM as described in the brief description of FIG. 3. Recombinant mouse IL-12 (rmIL12) was also added to a subset of "Mock" cultures ("Mock+rmIL12"). Each condition in FIGS. 4A-4D represent 50,000 CD8+ T cells cultured with a fixed number of HeLa cells from a HeLa cell culture transfected with one of the noted constructs and further including a fixed amount of supernatant from the same HeLa cell culture.

Figures 5A, 5B:
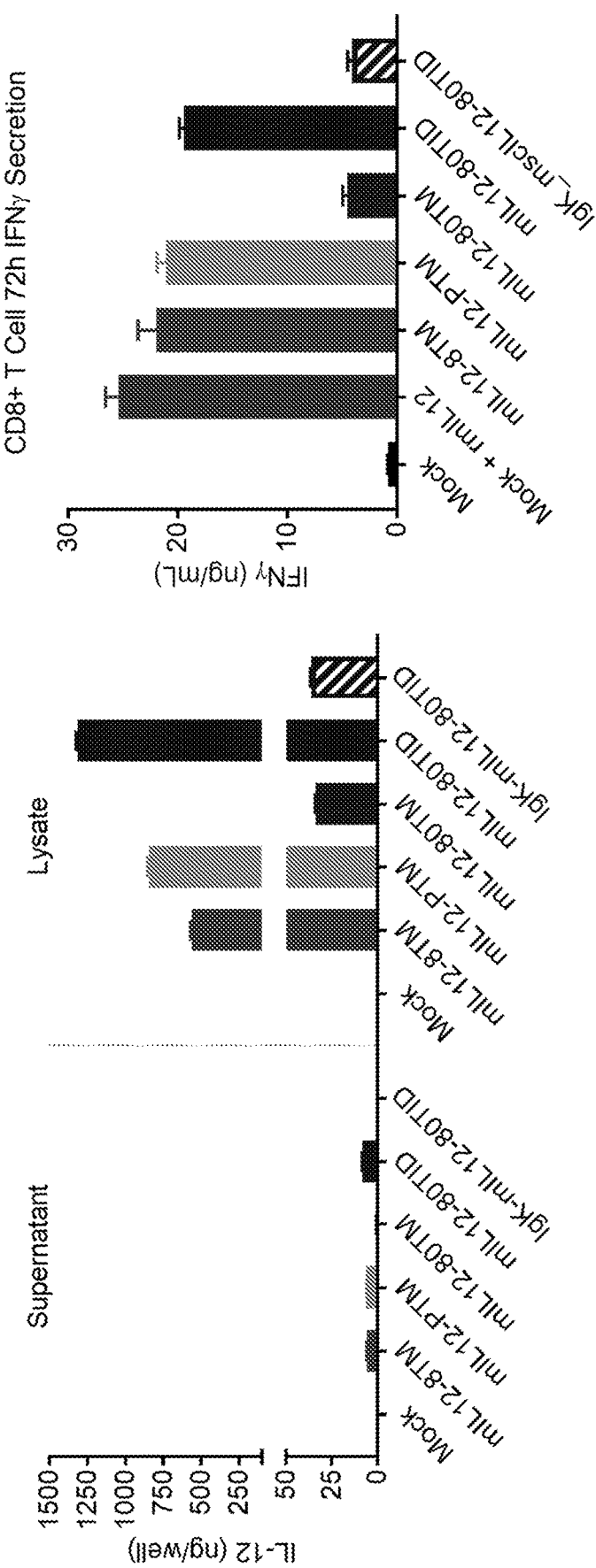

FIGS. 5A and 5B show in vitro IL-12 protein expression and bioactivity on mouse splenic CD8+ T cells of HeLa cells transfected with IL-12 polypeptide constructs. FIG. 5A shows the amount of IL-12 (ng/well) in the supernatant or lysates of "Mock" HeLa cells or HeLa cells 24 hours after transfection in individual cell culture wells with various tethered murine IL-12 mRNAs. FIG. 5B shows the amount of IFNγ secretion (ng/mL) by mouse splenic CD8+ T cells after 72 hours of co-culture with "Mock" or transfected HeLa cells and supernatant.

Figure 6A:
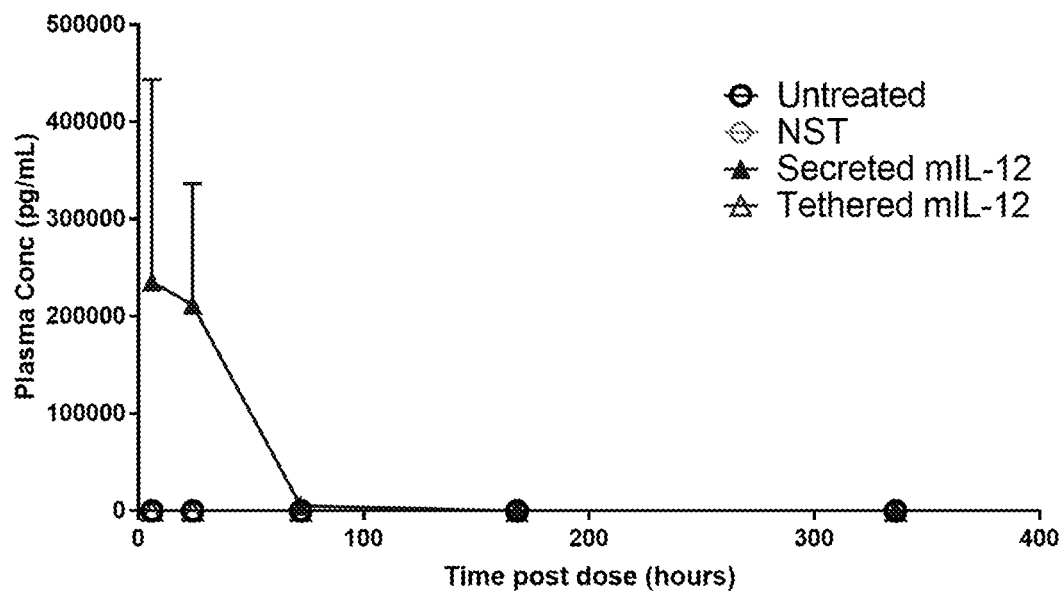
Figure 6B:
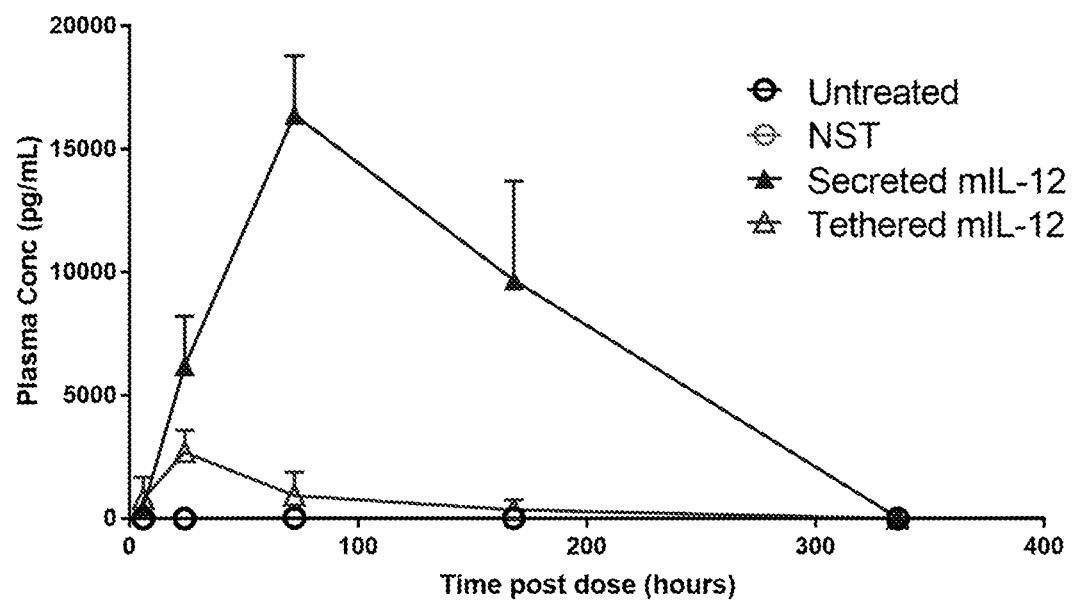

FIGS. 6A and 6B show the plasma levels of IL-12 (FIG. 6A) and IFNγ (FIG. 6B) from mice having MC38 tumors, after treatment with mIL12AB ("secreted mIL-12") or mIL12-PTM ("tethered mIL-12"). Each graph shows plasma concentration in picograms per milliliter ("pg/mL") over time post dose in hours.

Figure 7:
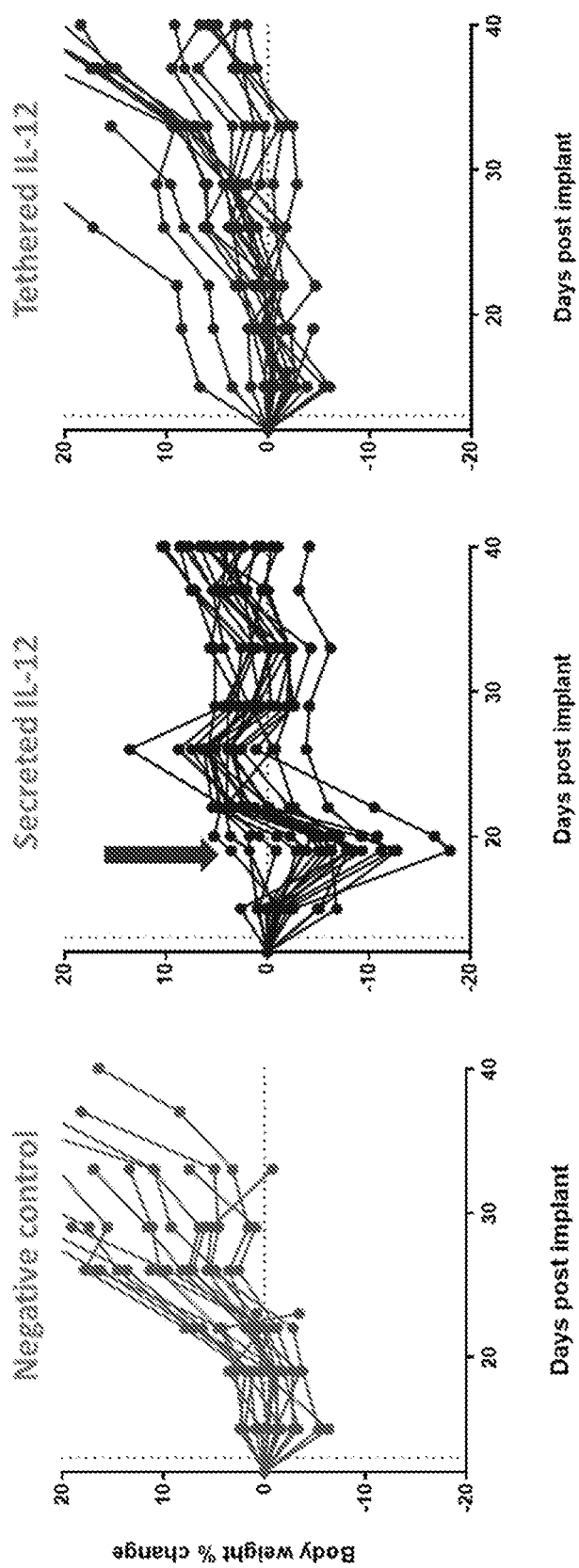

FIG. 7 provides graphs showing the percentage of body weight change over time (days) post implant of MC38 tumors into mice. The vertical line indicates the day treatment began with either negative control (NST mRNA; left), secreted IL-12 (mIL12AB; middle) or tethered IL-12 (mIL12-PTM; right).

Figure 8D:
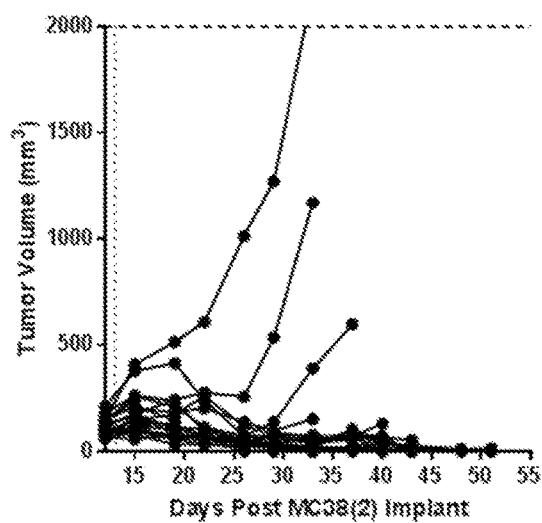
Figure 8E:
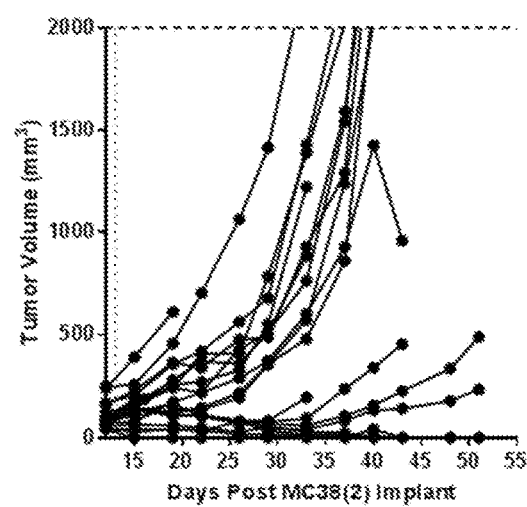

FIGS. 8A-8E show in vivo tumor efficacy in both primary treated and secondary untreated (i.e., distal) tumors with either a negative control mRNA encoding an untranslatable sequence of mOX40L ("Negative Control"), or mIL12-PTM mRNA construct as described in the brief description of FIG. 2B. FIG. 8A shows a schematic description of the MC38 dual flank model used in the experiments. "5e5" indicates that $5 \times 10^5$ MC38 cells were inoculated into the primary (right) or secondary (left) flanks to produce the tumors. Tumors in the right flank (primary tumors) were treated by intratumoral injection of one of the mRNAs, while tumors in the left flank (secondary tumors (i.e., distal tumors)) did not receive intratumoral injections. The effect of intratumoral administration of the mRNA in the primary tumor was determined by measuring tumor volume in both the primary tumor and the secondary tumor. The y-axes of FIGS. 8B-8E show tumor volume in cubic millimeters ($mm^3$) at the number of days indicated on the x-axis post implant with MC38. FIG. 8B shows the effect of the negative control mRNA on the primary treated tumor. FIG. 8C shows the effect of the negative control mRNA on the secondary tumor. FIG. 8D shows the effect of mIL12-PTM on the primary treated tumor. FIG. 8E shows the effect of mIL12-PTM on the secondary tumor.

Figure 9A:
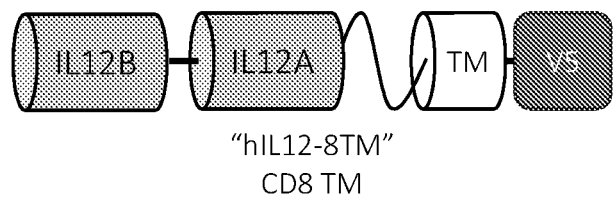
Figure 9B:
Figure 9C:
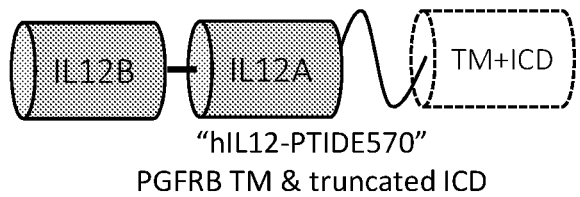
Figure 9D:
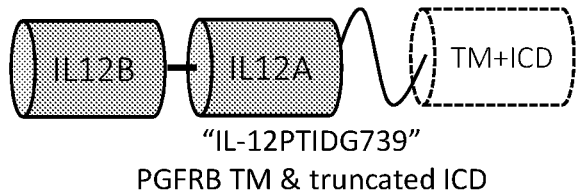

FIGS. 9A-9D show structures of tethered human IL-12 polypeptides, comprising an IL-12B subunit linked to an IL-12A subunit via a linker, as used in the Examples. FIG. 9A shows an IL-12 polypeptide linked to a CD8 transmembrane domain via a linker, with a V5 tag ("hIL12-8TM"). FIG. 9B shows an IL-12 polypeptide linked to a CD80 transmembrane domain and intracellular domain via a linker ("hIL12-80TID"). FIG. 9C shows an IL-12 polypeptide linked to a PGFRB transmembrane domain and truncated intracellular domain (E570tr), via a linker ("hIL12-PTIDE570"). FIG. 9D shows an IL-12 polypeptide linked to a PGFRB transmembrane domain and truncated intracellular domain (G739tr), via a linker ("hIL12-PTIDG739").

Figure 10A:
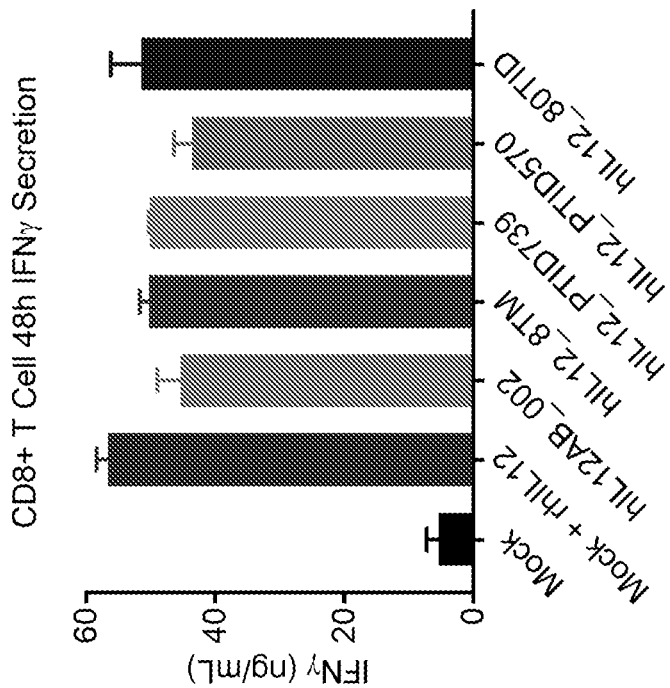
Figure 10B:
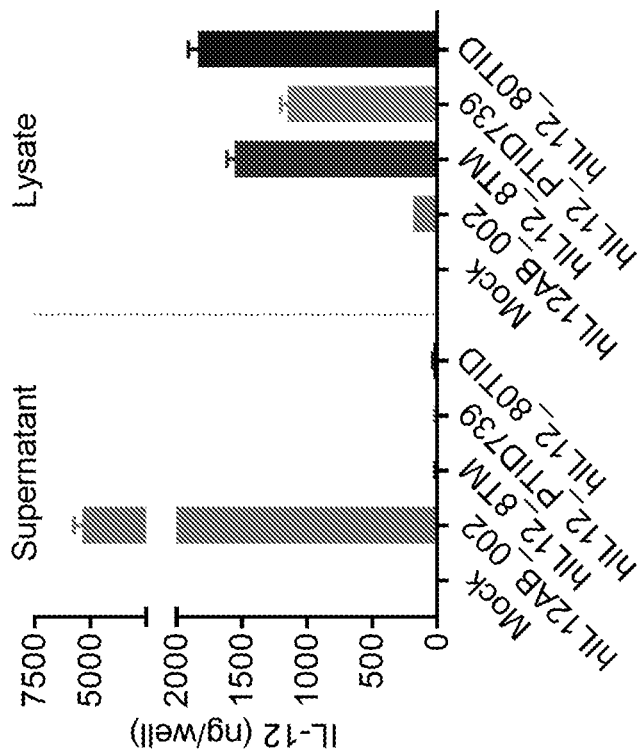

FIGS. 10A and 10B show in vitro IL-12 protein expression and bioactivity on human peripheral blood CD8+ T cells of HeLa cells transfected with IL-12 polypeptide constructs. FIG. 10A shows the amount of IL-12 (ng/well) in the supernatant or lysates of "Mock" HeLa cells or HeLa cells 24 hours after transfection in individual cell culture wells with various tethered human IL-12 mRNAs 24 hours after transfection. FIG. 10B shows the amount of IFNγ secretion (ng/mL) by human peripheral blood CD8+ T cells after 72 hours of co-culture with "Mock" or transfected HeLa cells and supernatants.

Figure 11:
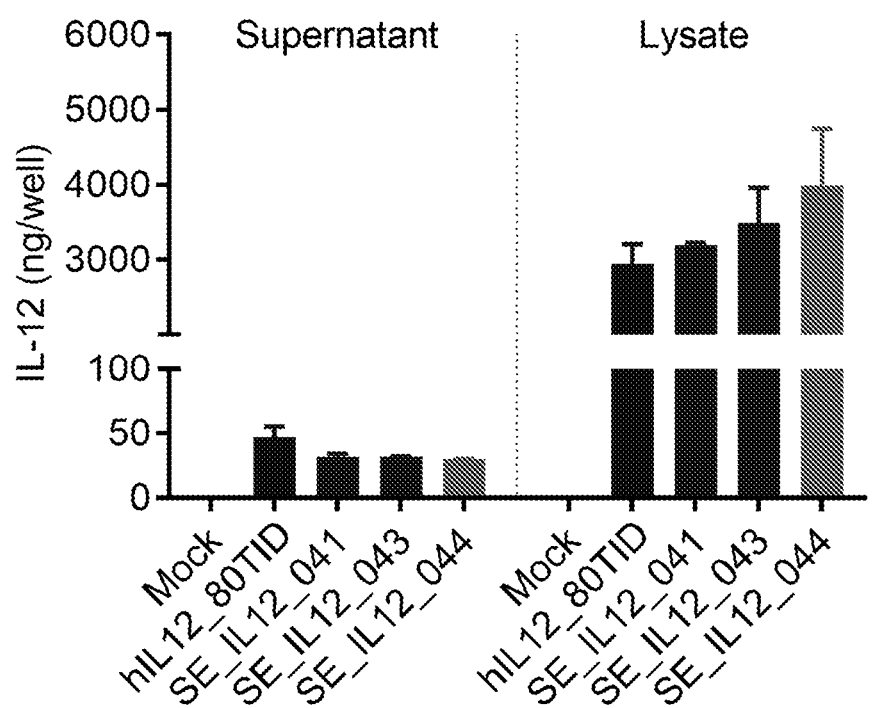

FIG. 11 shows in vitro IL-12 protein expression of hIL12-80TID encoded by four different mRNA sequences. The graph shows the amount of IL-12 (ng/well) in the supernatant (left) or lysates (right) of "Mock" HeLa cells or HeLa cells transfected in individual wells with the various mRNAs 24 hours after transfection.

DETAILED DESCRIPTION

The present disclosure provides a new approach to treat cancer involving the prevention or treatment of disease with substances (e.g., mRNAs encoding a tethered IL-12 polypeptide, which comprises an IL-12 polypeptide and a membrane domain as disclosed herein) that stimulate the immune response, i.e., immunotherapy.

In one aspect, the disclosure relates to methods of treating cancer using a polynucleotide (e.g., mRNA) encoding a tethered IL-12 polypeptide. An IL-12 polypeptide as disclosed herein comprises IL-12A, IL-12B, or both IL-12A and IL-12B. In another aspect, the disclosure provides methods of treating cancer using a combination approach that features a polynucleotide (e.g., mRNA) encoding a tethered IL-12 polypeptide and an anti-cancer agent, e.g., an immune-checkpoint inhibitor, e.g., anti-PD-1 antibody, anti-PD-L1 antibody, and/or anti-CTLA-4 antibody. Without being bound by any theory, it is believed that priming of an anti-cancer immune response is possible by administering, e.g., intratumorally, a polynucleotide (e.g., mRNA) encoding a tethered IL-12 polypeptide in the stimulation of, for example, T-cells and/or natural killer cells. Therefore, a polynucleotide (e.g., mRNA) encoding a tethered IL-12 polypeptide is believed to provide a first stimulation signal to the immune system, for example, within the tumor environment, e.g., via intratumoral injection of the polynucleotide (e.g., mRNA). IL-12 can also stimulate the production of interferon-gamma (IFN-γ) and tumor necrosis factor-alpha (TNF-α) from T cells and natural killer (NK) cells. As disclosed herein, IL-12, either directly or indirectly through IFN-γ, can also increase expression of PD-L1 in tumor cells, which can impair local tumor immunity. Therefore, in some aspects, the disclosure provides a method of treating a tumor comprising administering a polynucleotide (e.g., mRNA) encoding a tethered IL-12 polypeptide in combination with an anti-PD-1 antibody or anti-PD-L1 antibody to block the interaction between PD-L1 and its receptor, i.e., PD-1. In other aspects, the disclosure includes a method of treating a tumor comprising administering a polynucleotide (e.g., mRNA) encoding a tethered IL-12 polypeptide in combination with an anti-CTLA-4 antibody. In further aspects, the disclosure provides a method of treating a tumor comprising administering a polynucleotide (e.g., mRNA) encoding a tethered IL-12 polypeptide in combination with an anti-PD-1 antibody or anti-PD-L1 antibody and an anti-CTLA-4 antibody. Some aspects of the disclosure also include additional agents, e.g., an antibody. In other aspects, the anti-PD-1 antibody or anti-PD-L1 antibody can be administered in the form of a polynucleotide. Similarly, the anti-CTLA-4 antibody can be administered in the form of a polynucleotide. Exemplary aspects feature treatment with lipid nanoparticle-(LNP-) encapsulated mRNAs. Exemplary aspects feature intratumoral administration of mRNAs in cationic lipid-based LNPs.

1. Methods of Treating Cancer

Certain aspects of the present disclosure are directed to methods of reducing or decreasing size, mass, and/or volume of a tumor or preventing the growth of a tumor in a subject in need thereof comprising administering a polynucleotide, e.g., mRNA, encoding a tethered IL-12 polypeptide disclosed herein, or a vector or a host cell comprising the polynucleotide, or a tethered IL-12 polypeptide encoded by the polynucleotide.

In other embodiments, the present disclosure provides methods of promoting an anti-tumor effect (e.g., induce T cell proliferation, induce T cell infiltration in a tumor, induce a memory T cell response, increasing the number of NK cells, etc.) by administering the polynucleotide (e.g., mRNA) encoding a tethered IL-12 polypeptide or the polynucleotide in combination with any agents disclosed herein.

In one embodiment, the present disclosure provides a method of activating T cells in a subject in need thereof, inducing T cell proliferation in a subject in need thereof, inducing T cell infiltration in a tumor of a subject in need thereof, and/or inducing a memory T cell response in a subject in need thereof, comprising administering to the subject a polynucleotide encoding a tethered IL-12 polypeptide alone or in combination with a second agent, e.g., a checkpoint inhibitor, e.g., an anti-PD-1 antibody, an anti-PD-L1 antibody, and/or an anti-CTLA-4 antibody. In certain embodiments, the intratumoral administration of the polynucleotide (e.g., mRNA) encoding a tethered IL-12 polypeptide alone or in combination with a second agent can increase the efficacy of the anti-tumor effect (e.g., T cell infiltration in a tumor) compared to other routes of administration.

Administration of cytokines, such as IL-12, has been associated with toxicities in treated subjects. See, e.g., Leonard, J. P. et al., *Blood* 90: 2541-2548 (1997). In other embodiments, the present disclosure provides a method of reducing the size of a tumor or inhibiting the growth of a tumor in a subject in need thereof with reduced toxicity, comprising administering to the subject a polynucleotide (e.g., mRNA) encoding a tethered IL-12 polypeptide disclosed herein. In some embodiments, the administration exhibits reduced toxicity compared to an administration of a reference polynucleotide (e.g., mRNA) encoding an IL-12 polypeptide that is not tethered. In some embodiments, the reduced toxicity is a reduction in a toxicity or a toxic effect selected from the group consisting of: systemic toxicity, sepsis-like syndrome, septic shock, cachexia, loss of weight, muscle atrophy, fatigue, weakness, significant loss of appetite, hepatotoxicity, a decrease in circulating leukocytes, thrombocytopenia, anemia, dyspnea, stomatitis, leukopenia, hyperbilirubinemia, elevations in transaminases, thrombocytopenia, organ failure, respiratory failure, liver failure, renal failure, gastrointestinal bleeding, and combinations thereof.

In one embodiment, activated T cells in the subject reduce the size of a tumor or inhibit the growth of a tumor in the subject. Activation of T cells can be measured using applications in the art such as measuring T cell proliferation; measuring cytokine production with enzyme-linked immunosorbent assays (ELISA) or enzyme-linked immunospot assays (ELISPOT); or detection of cell-surface markers associated with T cell activation (e.g., CD69, CD40L, CD137, CD25, CD71, CD26, CD27, CD28, CD30, CD154, and CD134) with techniques such as flow cytometry.

In one embodiment, T cell proliferation in the subject is directed to an anti-tumor immune response in the subject. In another aspect, the T cell proliferation in the subject reduces or decreases the size of a tumor or inhibits the growth of a tumor in the subject. T cell proliferation can be measured using applications in the art such as cell counting, viability staining, optical density assays, or detection of cell-surface markers associated with T cell activation (e.g., CD69, CD40L, CD137, CD25, CD71, CD26, CD27, CD28, CD30, CD154, and CD134) with techniques such as flow cytometry.

In one embodiment, T cell infiltration in a tumor of the subject is directed to an anti-tumor immune response in the subject. In another aspect, the T cell infiltration in a tumor of the subject reduces or decreases the size of a tumor or inhibits the growth of a tumor in the subject. T cell infiltration in a tumor can be measured using applications in the art such as tissue sectioning and staining for cell markers, measuring local cytokine production at the tumor site, or detection of T cell-surface markers with techniques such as flow cytometry.

In one embodiment, the memory T cell response in the subject is directed to an anti-tumor immune response in the subject. In another aspect, the memory T cell response in the subject reduces or decreases the size of a tumor or inhibits the growth of a tumor in the subject. A memory T cell response can be measured using applications in the art such as measuring T cell markers associated with memory T cells, measuring local cytokine production related to memory immune response, or detecting memory T cell-surface markers with techniques such as flow cytometry.

In certain embodiments, the T cells activated by the present methods are $CD4^+$ cells, $CD8^+$ cells, $CD62^+$ (L-selectin$^+$) cells, $CD69^+$ cells, $CD40L^+$ cells, $CD137^+$ cells, $CD25^+$ cells, $CD71^+$ cells, $CD26^+$ cells, $CD27^+$ cells, $CD28^+$ cells, $CD30^+$ cells, $CD45^+$ cells, $CD45RA^+$ cells, $CD45RO^+$ cells, $CD11b^+$ cells, $CD154^+$ cells, $CD134^+$ cells, $CXCR3^+$ cells, $CCR4^+$ cells, $CCR6^+$ cells, $CCR7^+$ cells, $CXCR5^+$ cells, $Crth2^+$ cells, gamma delta T cells, or any combination thereof. In some embodiments, the T cells activated by the present methods are $Th_1$ cells. In other embodiments, the T cells activated by the present methods are $Th_2$ cells. In other embodiments, the T cells activated by the present methods are cytotoxic T cells.

In some embodiments, the infiltrating T cells induced by the present methods are $CD4^+$ cells, $CD8^+$ cells, $CD62^+$ (L-selectin$^+$) cells, $CD69^+$ cells, $CD40L^+$ cells, $CD137^+$ cells, $CD25^+$ cells, $CD71^+$ cells, $CD26^+$ cells, $CD27^+$ cells, $CD28^+$ cells, $CD30^+$ cells, $CD45^+$ cells, $CD45RA^+$ cells, $CD45RO^+$ cells, $CD11b^+$ cells, $CD154^+$ cells, $CD134^+$ cells, $CXCR3^+$ cells, $CCR4^+$ cells, $CCR6^+$ cells, $CCR7^+$ cells, $CXCR5^+$ cells, $Crth2^+$ cells, gamma delta T cells, or any combination thereof. In some embodiments, the infiltrating T cells induced by the present methods are $Th_1$ cells. In other embodiments, the infiltrating T cells induced by the present methods are $Th_2$ cells. In other embodiments, the infiltrating T cells induced by the present methods are cytotoxic T cells.

In some embodiments, the memory T cells induced by the present methods are $CD4^+$ cells, $CD8^+$ cells, $CD62^+$ (L-selectin$^+$) cells, $CD69^+$ cells, $CD40L^+$ cells, $CD137^+$ cells, $CD25^+$ cells, $CD71^+$ cells, $CD26^+$ cells, $CD27^+$ cells, $CD28^+$ cells, $CD30^+$ cells, $CD45^+$ cells, $CD45RA^+$ cells, $CD45RO^+$ cells, $CD11b^+$ cells, $CD154^+$ cells, $CD134^+$ cells, $CXCR3^+$ cells, $CCR4^+$ cells, $CCR6^+$ cells, $CCR7^+$ cells, $CXCR5^+$ cells, $Crth2^+$ cells, gamma delta T cells, or any combination thereof. In some embodiments, the memory T cells induced by the present methods are $Th_1$ cells. In other embodiments, the memory T cells induced by the present methods are $Th_2$ cells. In other embodiments, the memory T cells induced by the present methods are cytotoxic T cells.

In certain embodiments, the disclosure provides a method of inducing an adaptive immune response, an innate immune response, or both adaptive and innate immune response against a tumor, comprising administering a polynucleotide, e.g., mRNA, encoding a tethered IL-12 polypeptide alone or in combination with a second agent, e.g., a checkpoint inhibitor, e.g., an anti-PD-1 antibody, an anti-PD-L1 antibody, and/or an anti-CTLA-4 antibody, and/or any other agents disclosed herein. In some embodiments, the disclosure provides a method of inducing an adaptive immune response, an innate immune response, or both adaptive and innate immune response against a tumor, comprising administering a polynucleotide, e.g., mRNA, encoding a tethered IL-12 polypeptide in combination with a second agent, e.g., a checkpoint inhibitor, e.g., an anti-PD-1 antibody, an anti-PD-L1 antibody, and/or an anti-CTLA-4 antibody, and/or any other agents disclosed herein. In some embodiments, the checkpoint inhibitor can be a polynucleotide (e.g., mRNA)

encoding an antibody or an antigen-binding portion thereof, e.g., an anti-PD-1 antibody, an anti-PD-L1 antibody, and/or an anti-CTLA-4 antibody. In some embodiments, the disclosure provides a method of inducing an adaptive immune response, an innate immune response, or both adaptive and innate immune response against a tumor, comprising administering a polynucleotide, e.g., mRNA, encoding a tethered IL-12 polypeptide.

The present disclosure further provides a method of increasing the number of Natural Killer (NK) cells in a subject in need thereof, comprising administering a polynucleotide comprising an mRNA encoding a tethered IL-12 polypeptide alone or in combination with a second agent, e.g., a checkpoint inhibitor, e.g., an anti-PD-1 antibody, an anti-PD-L1 antibody, and/or an anti-CTLA-4 antibody, and/ or any other agents disclosed herein. In some embodiments, the disclosure provides a method of increasing the number of Natural Killer (NK) cells in a subject in need thereof, comprising administering a polynucleotide comprising an mRNA encoding a tethered IL-12 polypeptide. In some embodiments, the disclosure provides a method of increasing the number of Natural Killer (NK) cells in a subject in need thereof, comprising administering a polynucleotide comprising an mRNA encoding a tethered IL-12 polypeptide in combination with a second agent, e.g., a checkpoint inhibitor, e.g., an anti-PD-1 antibody, an anti-PD-L1 antibody, and/or an anti-CTLA-4 antibody, and/or any other agents disclosed herein. In one aspect, the increase in the number of NK cells in the subject is directed to an anti-tumor immune response in the subject. In another aspect, the increase in the number of NK cells in the subject reduces or decreases the size of a tumor or inhibits the growth of a tumor in the subject. Increases in the number of NK cells in a subject can be measured using applications in the art such as detection of NK cell-surface markers (e.g., CD335/NKp46; CD336/NKp44; CD337/NPp30) or intracellular NK cell markers (e.g., perform; granzymes; granulysin).

In certain embodiments, the present disclosure is also directed to a method of increasing IFNγ expression in a subject having tumor comprising administering a polynucleotide encoding a tethered IL-12 polypeptide alone or in combination with a second agent, e.g., a checkpoint inhibitor, e.g., an anti-PD-1 antibody, an anti-PD-L1 antibody, and/or an anti-CTLA-4 antibody, and/or any other agents disclosed herein. In some embodiments, the disclosure provides a method of increasing IFNγ expression in a subject having tumor comprising administering a polynucleotide encoding a tethered IL-12 polypeptide. In some embodiments, the disclosure provides a method of increasing IFNγ expression in a subject having tumor comprising administering a polynucleotide encoding a tethered IL-12 polypeptide in combination with a second agent, e.g., a checkpoint inhibitor, e.g., an anti-PD-1 antibody, an anti-PD-L1 antibody, and/or an anti-CTLA-4 antibody, and/or any other agents disclosed herein.

Other embodiments also include a method of increasing expression of IFNγ, TNFα, IL-10, IL-13, IL-15/15R, IL-27, MIP-1β, MIP-1α, MCP-1, MCP-3, M-CSF, IL-4, IL-5, or any combination thereof in a subject having tumor comprising administering a polynucleotide, e.g., mRNA, encoding a tethered IL-12 polypeptide alone or in combination with another agent disclosed herein. In yet other embodiments, the methods of the present disclosure can include methods of inducing expression of GM-CSF, IL-18, IL-3, RANTES, IL-6, or any combination thereof.

The polynucleotide encoding a tethered IL-12 polypeptide can be formulated as a pharmaceutical composition that is suitable for administration either directly or indirectly to tumors. The term "tumor" is used herein in a broad sense and refers to any abnormal new growth of tissue that possesses no physiological function and arises from uncontrolled usually rapid cellular proliferation. The term "tumor" as used herein relates to both benign tumors and to malignant tumors.

Certain aspects of the disclosure provide methods of intratumorally administering a single dose of a polynucleotide, e.g., mRNA, encoding a tethered IL-12 polypeptide alone or in combination with any agents disclosed herein. In some embodiments, the disclosure provides methods of intratumorally administering a single dose of a polynucleotide, e.g., mRNA, encoding a tethered IL-12 polypeptide. In some embodiments, the disclosure provides methods of intratumorally administering a single dose of a polynucleotide, e.g., mRNA, encoding a tethered IL-12 polypeptide alone or in combination with any agents disclosed herein. In such embodiments, an mRNA encoding a tethered IL-12 polypeptide can be administered only once while the other agent can be administered regularly, following its regular dosing schedule. In certain embodiments, a checkpoint inhibitor, e.g., an anti-PD-1 antibody, an anti-PD-L1 antibody, and/or an anti-CTLA-4 antibody, is administered prior to administration of a polynucleotide, e.g., mRNA, encoding a tethered IL-12 polypeptide. In some embodiments, the polynucleotide is formulated in a lipid nanoparticle, e.g., Compound 18 based lipid nanoparticle, disclosed herein. Not being bound by any theory, in some aspects, the intratumoral delivery of a polynucleotide encoding a tethered IL-12 polypeptide and/or the lipid nanoparticle formulation disclosed herein allows single dose administration that is sufficient for the dose to trigger anti-tumor efficacy and treat the tumor. Given the potential toxicity of IFNγ induced by IL-12, this single dosing regimen of the disclosed polynucleotide can be beneficial to the subjects in need of the treatment.

In certain embodiments, the method comprises administering a single dose of a polynucleotide, e.g., mRNA, encoding a tethered IL-12 polypeptide in combination with a second agent, e.g., an anti-PD-1 antibody, an anti-PD-L1 antibody, and/or an anti-CTLA-4 antibody, which can be given also in single administration or multiple administrations following its regular (e.g., approved) schedule. In other embodiments, the method comprises not more than two administrations of a polynucleotide, e.g., mRNA, encoding a tethered IL-12 polypeptide, not more than three administrations of a polynucleotide, e.g., mRNA, encoding a tethered IL-12 polypeptide, not more than four administrations of a polynucleotide, e.g., mRNA, encoding a tethered IL-12 polypeptide, or not more than five administrations of a polynucleotide, e.g., mRNA, encoding a tethered IL-12 polypeptide, optionally in combination with a checkpoint inhibitor, e.g., an anti-PD-1 antibody, an anti-PD-L1 antibody, and/or an anti-CTLA-4 antibody.

In other embodiments, the present methods can result in abscopal effects, e.g., a treatment of tumor where localized treatment of a tumor, e.g., intratumoral delivery, by a polynucleotide, e.g., mRNA, encoding a tethered IL-12 polypeptide causes not only a shrinking of the treated tumor, but also a shrinking of tumors outside the scope of the localized treatment ("distal tumor").

In some embodiments, the administering of a polynucleotide encoding a tethered IL-12 polypeptide (alone or in combination with an anti-PD-L1 antibody, an anti-PD-1 antibody, or an anti-CTLA-4 antibody) increases an effector to suppressor T cell ratio in the tumor. In certain embodiments, the effector to suppressor T cell ratio is characterized by the ratio of (i) CD8+, CD4+, or CD8+/CD4+ T cells to (ii) Treg cells in a subject. In certain embodiments, the increase in the effector to suppressor T cell ratio correlates with an increase in the number of CD8+ T cells. In some embodiments, the increase in the effector to suppressor T cell ratio correlates with an increase in the number of CD4+ T cells. In some embodiments, the increase in the effector to suppressor T cell ratio correlates with an increase in the number of CD8+/CD4+ T cells. In some embodiments, the increase in the effector to suppressor T cell ratio correlates with a decrease in the number of Treg cells.

In some embodiments, the effector to suppressor T cell ratio, e.g., the $CD8^+$ T cell to Treg cell ratio, following administration of a polynucleotide encoding a tethered IL-12 polypeptide (alone or in combination with an anti-PD-L1 antibody, an anti-PD-1 antibody, and/or an anti-CTLA-4 antibody or a polynucleotide encoding the same) is at least about 1.5:1, at least about 2:1, at least about 2.5:1, at least about 3:1, at least about 3.5:1, at least about 3.5:1, at least about 4:1, at least about 4.5:1, at least about 5:1, at least about 6:1, at least about 7:1, at least about 8:1, at least about 9:1, at least about 10:1, at least about 15:1, at least about 20:1, at least about 25:1, at least about 30:1, at least about 35:1, at least about 40:1, at least about 45:1, at least about 50:1, at least about 60:1, at least about 70:1, at least about 80:1, at least about 90:1, at least about 100:1, at least about 110:1, at least about 120:1, at least about 130:1, at least about 140:1, at least about 150:1, at least about 200:1, at least about 250:1, or at least about 500:1.

In some embodiments, the effector to suppressor T cell ratio, e.g., the $CD8^+$ T cell to Treg cell ratio, following administration of a polynucleotide encoding a tethered IL-12 polypeptide (alone or in combination with an anti-PD-L1 antibody, an anti-PD-1 antibody, and/or an anti-CTLA-4 antibody or a polynucleotide encoding the same) is at least about 1.5, at least about 2, at least about 2.5, at least about 3, at least about 3.5, at least about 3.5, at least about 4, at least about 4.5, at least about 5, at least about 6, at least about 7, at least about 8, at least about 9, at least about 10, at least about 15, at least about 20, at least about 25, at least about 30, at least about 35, at least about 40, at least about 45, at least about 50, at least about 60, at least about 70, at least about 80, at least about 90, at least about 100, at least about 110, at least about 120, at least about 130, at least about 140, at least about 150, at least about 200, at least about 250, or at least about 500.

In one embodiment, the increase in the effector to suppressor T cell ratio in the tumor is directed to an anti-tumor immune response in the subject. In another aspect, the increase in the effector to suppressor T cell ratio in the tumor reduces or decreases the size of a tumor or inhibits the growth of a tumor in the subject. The effector to suppressor T cell ratio in the tumor can be measured using applications in the art such as measuring the ratio of CD8+, CD4+, or CD8+/CD4+ T cells to Treg cells, using any methods known in the art including IHC and/or flow cytometry.

The delivery of the polynucleotide encoding a tethered IL-12 polypeptide to a tumor using a pharmaceutical composition for intratumoral administration disclosed herein can:
(a) increase the retention of the polynucleotide in the tumor;
(b) increase the levels of expressed polypeptide in the tumor compared to the levels of expressed polypeptide in peritumoral tissue;
(c) decrease leakage of the polynucleotide or expressed product to off-target tissue (e.g., peritumoral tissue, or to distant locations, e.g., liver tissue); or,
(d) any combination thereof,
wherein the increase or decrease observed for a certain property is relative to a corresponding reference composition (e.g., composition in which compounds of formula (I) are not present or have been substituted by another ionizable amino lipid, e.g., MC3).

In one embodiment, a decrease in leakage can be quantified as decrease in the ratio of polypeptide expression in the tumor to polypeptide expression in non-tumor tissues, such as peritumoral tissue or to another tissue or organ, e.g., liver tissue.

Delivery of a polynucleotide, e.g., mRNA, encoding a tethered IL-12 polypeptide to a tumor involves administering a pharmaceutical composition disclosed herein, e.g., in nanoparticle form, including the polynucleotide, e.g., mRNA, encoding a tethered IL-12 polypeptide to a subject, where administration of the pharmaceutical composition involves contacting the tumor with the composition.

In the instance that the polynucleotide encoding a tethered IL-12 polypeptide is an mRNA, upon contacting a cell in the tumor with the pharmaceutical composition, a translatable mRNA may be translated in the cell to produce a polypeptide of interest. However, mRNAs that are substantially not translatable may also be delivered to tumors. Substantially non-translatable mRNAs may be useful as vaccines and/or may sequester translational components of a cell to reduce expression of other species in the cell.

The pharmaceutical compositions disclosed herein can increase specific delivery. As used herein, the term "specific delivery," means delivery of more (e.g., at least 1.5 fold more, at least 2-fold more, at least 3-fold more, at least 4-fold more, at least 5-fold more, at least 6-fold more, at least 7-fold more, at least 8-fold more, at least 9-fold more, or at least 10-fold more) of a polynucleotide, e.g., mRNA, encoding a tethered IL-12 polypeptide by pharmaceutical composition disclosed herein (e.g., in nanoparticle form) to a target tissue of interest (e.g., a tumor) compared to an off-target tissue (e.g., mammalian liver).

The level of delivery of a nanoparticle to a particular tissue may be measured, for example, by comparing
(i) the amount of protein expressed from a polynucleotide, e.g., mRNA, encoding a tethered IL-12 polypeptide in a tissue to the weight of said tissue;
(ii) comparing the amount of the polynucleotide, e.g., mRNA, in a tissue to the weight of said tissue; or
(iii) comparing the amount of protein expressed from a polynucleotide, e.g., mRNA, encoding a tethered IL-12 polypeptide in a tissue to the amount of total protein in said tissue.

Specific delivery to a tumor or a particular class of cells in the tumor implies that a higher proportion of pharmaceutical composition including a polynucleotide, e.g., mRNA, encoding a tethered IL-12 polypeptide is delivered to the target destination (e.g., target tissue) relative to other off-target destinations upon administration of a pharmaceutical composition to a subject.

The present disclosure also provides methods to deliver intratumorally a polynucleotide, e.g., mRNA, encoding a tethered IL-12 polypeptide when a pharmaceutical composition comprising the polynucleotides disclosed herein (e.g., in nanoparticle form) are administered to a tumor. The intratumoral administration can show one or more properties selected from:

(i) increased retention of the polynucleotide, e.g., mRNA, encoding a tethered IL-12 polypeptide in the tumor;

(ii) increased levels of expressed polypeptide in the tumor compared to the levels of expressed polypeptide in peritumoral tissue;

(iii) decreased leakage of the polynucleotide, e.g., mRNA, or expressed product to off-target tissue (e.g., peritumoral tissue, or to distant locations, e.g., liver tissue); and, (iv) any combination thereof, wherein the increase or decrease observed for a certain property is relative to a corresponding reference composition (e.g., composition in which compounds of formula (I) are not present or have been substituted by another ionizable amino lipid, e.g., MC3).

In one embodiment, a decrease in leakage can be quantified as decrease in the ratio of polypeptide expression in the tumor to polypeptide expression in non-tumor tissues, such as peritumoral tissue or to another tissue or organ, e.g., liver tissue.

In some embodiments, another improvement in delivery caused as a result of using the pharmaceutical compositions disclosed herein is a reduction in immune response with respect to the immune response observed when other lipid components are used to deliver the same a therapeutic agent or polynucleotide encoding a therapeutic agent.

Accordingly, the present disclosure provides a method of increasing retention of a therapeutic agent (e.g., a polypeptide administered as part of the pharmaceutical composition) in a tumor tissue in a subject, comprising administering intratumorally to the tumor tissue a pharmaceutical composition disclosed herein, wherein the retention of the therapeutic agent in the tumor tissue is increased compared to the retention of the therapeutic agent in the tumor tissue after administering a corresponding reference composition.

Also provided is a method of increasing retention of a polynucleotide in a tumor tissue in a subject, comprising administering intratumorally to the tumor tissue a pharmaceutical composition disclosed herein, wherein the retention of the polynucleotide in the tumor tissue is increased compared to the retention of the polynucleotide in the tumor tissue after administering a corresponding reference composition.

Also provided is a method of increasing retention of an expressed polypeptide in a tumor tissue in a subject, comprising administering to the tumor tissue a pharmaceutical composition disclosed herein, wherein the pharmaceutical composition comprises a polynucleotide encoding the expressed polypeptide, and wherein the retention of the expressed polypeptide in the tumor tissue is increased compared to the retention of the polypeptide in the tumor tissue after administering a corresponding reference composition.

The present disclosure also provides a method of decreasing expression leakage of a polynucleotide administered intratumorally to a subject in need thereof, comprising administering the polynucleotide intratumorally to the tumor tissue as a pharmaceutical composition disclosed herein, wherein the expression level of the polypeptide in non-tumor tissue is decreased compared to the expression level of the polypeptide in non-tumor tissue after administering a corresponding reference composition.

Also provided is a method of decreasing expression leakage of a therapeutic agent (e.g., a polypeptide administered as part of the pharmaceutical composition) administered intratumorally to a subject in need thereof, comprising administering the therapeutic agent intratumorally to the tumor tissue as a pharmaceutical composition disclosed herein, wherein the amount of therapeutic agent in non-tumor tissue is decreased compared to the amount of therapeutic in non-tumor tissue after administering a corresponding reference composition.

Also provided is a method of decreasing expression leakage of an expressed polypeptide in a tumor in a subject, comprising administering to the tumor tissue a pharmaceutical composition disclosed herein, wherein the pharmaceutical composition comprises a polynucleotide encoding the expressed polypeptide, and wherein the amount of expressed polypeptide in non-tumor tissue is decreased compared to the amount of expressed polypeptide in non-tumor tissue after administering a corresponding reference composition.

In some embodiments, the non-tumoral tissue is peritumoral tissue. In other embodiments, the non-tumoral tissue is liver tissue.

The present disclosure also provides a method to reduce or prevent the immune response caused by the intratumoral administration of a pharmaceutical composition, e.g., a pharmaceutical composition comprising lipids known in the art, by replacing one or all the lipids in such composition with a compound of Formula (I). For example, the immune response caused by the administration of a polynucleotide, e.g., mRNA, encoding a tethered IL-12 polypeptide in a pharmaceutical composition comprising MC3 (or other lipids known in the art) can be prevented (avoided) or ameliorated by replacing MC3 with a compound of Formula (I), e.g., Compound 18.

In some embodiments, the immune response observed after a polynucleotide, e.g., mRNA, encoding a tethered IL-12 polypeptide is administered in a pharmaceutical composition disclosed herein is not elevated compared to the immune response observed when the therapeutic agent or a polynucleotide, e.g., mRNA, encoding a tethered IL-12 polypeptide is administered in phosphate buffered saline (PBS) or another physiological buffer solution (e.g., Ringer's solution, Tyrode's solution, Hank's balanced salt solution, etc.).

In some embodiments, the immune response observed after a therapeutic agent or a polynucleotide, e.g., mRNA, encoding a tethered IL-12 polypeptide is administered in a pharmaceutical composition disclosed herein is not elevated compared to the immune response observed when PBS or another physiological buffer solution is administered alone.

In some embodiments, no immune response is observed when a pharmaceutical composition disclosed herein is administered intratumorally to a subject.

Accordingly, the present disclosure also provides a method of delivering a therapeutic agent or a polynucleotide, e.g., mRNA, encoding a tethered IL-12 polypeptide to a subject in need thereof, comprising administering intratumorally to the subject a pharmaceutical composition disclosed herein, wherein the immune response caused by the administration of the pharmaceutical composition is not elevated compared to the immune response caused by the intratumoral administration of (i) PBS alone, or another physiological buffer solution (e.g., Ringer's solution, Tyrode's solution, Hank's balanced salt solution, etc.);

(ii) the therapeutic agent or polynucleotide, e.g., mRNA, encoding a tethered IL-12 polypeptide in PBS or another physiological buffer solution; or, (iii) a corresponding reference composition, i.e., the same pharmaceutical composition in which the compound of Formula (I) is substituted by another ionizable amino lipid, e.g., MC3.

In certain embodiments, the administration treats a cancer.

The polynucleotide (e.g., mRNA) of the present disclosure can be administered in any route available, including, but not limited to, intratumoral, enteral, gastroenteral, epidural, oral, transdermal, epidural (peridural), intracerebral (into the cerebrum), intracerebroventricular (into the cerebral ventricles), epicutaneous (application onto the skin), intradermal, (into the skin itself), subcutaneous (under the skin), nasal administration (through the nose), intravenous (into a vein), intraperitoneal (into the peritoneum), intraarterial (into an artery), intramuscular (into a muscle), intracardiac (into the heart), intraosseous infusion (into the bone marrow), intrathecal (into the spinal canal), intraperitoneal, (infusion or injection into the peritoneum), intravesical infusion, intravitreal, (through the eye), intracavernous injection, (into the base of the penis), intravaginal administration, intrauterine, extra-amniotic administration, transdermal (diffusion through the intact skin for systemic distribution), transmucosal (diffusion through a mucous membrane), insufflation (snorting), sublingual, sublabial, enema, eye drops (onto the conjunctiva), or in ear drops. In other embodiments, the polynucleotide, e.g., mRNA, of the present disclosure is administered parenterally (e.g., includes subcutaneous, intravenous, intraperitoneal, intratumoral, intramuscular, intra-articular, intra-synovial, intrasternal, intrathecal, intrahepatic, intralesional and intracranial injection or infusion techniques), intraventricularly, orally, by inhalation spray, topically, rectally, nasally, buccally, vaginally or via an implanted reservoir. In particular embodiments, the polynucleotide, composition, or polypeptide is administered subcutaneously, intravenously, intraperitoneally, intratumorally, intramuscularly, intra-articularly, intrasynovially, intrasternally, intrathecally, intrahepatically, intradermally, intralesionally, intracranially, intraventricularly, orally, by inhalation spray, topically, rectally, nasally, buccally, vaginally or via an implanted reservoir. In one particular embodiment, the polynucleotide (e.g., mRNA) of the present disclosure is administered intratumorally.

In some embodiments, the polynucleotide, e.g., mRNA, is delivered by a device comprising a pump, patch, drug reservoir, short needle device, single needle device, multiple needle device, micro-needle device, jet injection device, ballistic powder/particle delivery device, catheter, lumen, cryoprobe, cannula, microcanular, or devices utilizing heat, RF energy, electric current, or any combination thereof.

Other aspects of the present disclosure relate to transplantation of cells containing polynucleotides to a mammalian subject. Administration of cells to mammalian subjects is known to those of ordinary skill in the art, and includes, but is not limited to, local implantation (e.g., topical or subcutaneous administration), organ delivery or systemic injection (e.g., intravenous injection or inhalation), and the formulation of cells in pharmaceutically acceptable carriers.

In some embodiments, the polynucleotide, e.g., mRNA, is administered at an amount between about 0.10 µg per tumor and about 1000 mg per tumor.

In some embodiments, the administration of the polynucleotide, e.g., mRNA, pharmaceutical composition or formulation of the disclosure results in expression of IL-12 in cells of the subject. In some embodiments, administering the polynucleotide, e.g., mRNA, pharmaceutical composition or formulation of the disclosure results in an increase of IL-12 activity in the subject. For example, in some embodiments, the polynucleotides of the present disclosure are used in methods of administering a composition or formulation comprising an mRNA encoding a tethered IL-12 polypeptide to a subject, wherein the method results in an increase of IL-12 activity in at least some cells of a subject.

In some embodiments, the administration of a composition or formulation comprising an mRNA encoding a tethered IL-12 polypeptide to a subject results in an increase of IL-12 activity in cells subject to a level at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or to 100% or more of the activity level expected in a normal subject.

Other embodiments of the disclosure also provide a method of treating a cancer in a subject in need thereof comprising administering (e.g., intratumorally, intraperitoneally, or intravenously) a polynucleotide comprising an mRNA encoding a tethered IL-12 polypeptide with one or more anti-cancer agents to the subject.

In some embodiments, the polynucleotides (e.g., mRNA) encoding a tethered IL-12 polypeptide of the present disclosure can be used to reduce or decrease the size of a tumor or inhibit growth of a tumor in a subject in need thereof.

In some embodiments, the tumor is associated with a disease, disorder, and/or condition. In a particular embodiment, the disease, disorder, and/or condition is a cancer. Thus, in one aspect, the administration of the polynucleotide (e.g., mRNA) encoding a tethered IL-12 polypeptide treats a cancer.

A "cancer" refers to a broad group of various diseases characterized by the uncontrolled growth of abnormal cells in the body. Unregulated cell division and growth results in the formation of malignant tumors that invade neighboring tissues and can also metastasize to distant parts of the body through the lymphatic system or bloodstream. A "cancer" or "cancer tissue" can include a tumor at various stages. In certain embodiments, the cancer or tumor is stage 0, such that, e.g., the cancer or tumor is very early in development and has not metastasized. In some embodiments, the cancer or tumor is stage I, such that, e.g., the cancer or tumor is relatively small in size, has not spread into nearby tissue, and has not metastasized. In other embodiments, the cancer or tumor is stage II or stage III, such that, e.g., the cancer or tumor is larger than in stage 0 or stage I, and it has grown into neighboring tissues but it has not metastasized, except potentially to the lymph nodes. In other embodiments, the cancer or tumor is stage IV, such that, e.g., the cancer or tumor has metastasized. Stage IV can also be referred to as advanced or metastatic cancer.

In some aspects, the cancer can include, but is not limited to, adrenal cortical cancer, advanced cancer, anal cancer, aplastic anemia, bile duct cancer, bladder cancer, bone cancer, bone metastasis, brain tumors, brain cancer, breast cancer, childhood cancer, cancer of unknown primary origin, Castleman disease, cervical cancer, colon/rectal cancer, endometrial cancer, esophagus cancer, Ewing family of tumors, eye cancer, gallbladder cancer, gastrointestinal carcinoid tumors, gastrointestinal stromal tumors, gestational trophoblastic disease, Hodgkin disease, Kaposi sarcoma, renal cell carcinoma, laryngeal and hypopharyngeal cancer, acute lymphocytic leukemia, acute myeloid leukemia, chronic lymphocytic leukemia, chronic myeloid leukemia, chronic myelomonocytic leukemia, liver cancer, hepatocellular carcinoma (HCC), non-small cell lung cancer, small cell lung cancer, lung carcinoid tumor, lymphoma of the skin, malignant mesothelioma, multiple myeloma, myelodysplastic syndrome, nasal cavity and paranasal sinus cancer, nasopharyngeal cancer, neuroblastoma, non-Hodgkin lymphoma, oral cavity and oropharyngeal cancer, osteosarcoma, ovarian cancer, pancreatic cancer, penile cancer, pituitary tumors, prostate cancer, retinoblastoma, rhabdomyosarcoma, salivary gland cancer, sarcoma in adult soft tissue, basal and squamous cell skin cancer, melanoma, small intestine cancer, stomach cancer, testicular cancer, throat cancer, thymus cancer, thyroid cancer, uterine sarcoma, vaginal cancer, vulvar cancer, Waldenstrom macroglobulinemia, Wilms tumor, secondary cancers caused by cancer treatment, and any combination thereof.

In some aspects, the tumor is a solid tumor. A "solid tumor" includes, but is not limited to, sarcoma, melanoma, carcinoma, or other solid tumor cancer. "Sarcoma" refers to a tumor which is made up of a substance like the embryonic connective tissue and is generally composed of closely packed cells embedded in a fibrillar or homogeneous substance. Sarcomas include, but are not limited to, chondrosarcoma, fibrosarcoma, lymphosarcoma, melanosarcoma, myxosarcoma, osteosarcoma, Abemethy's sarcoma, adipose sarcoma, liposarcoma, alveolar soft part sarcoma, ameloblastic sarcoma, botryoid sarcoma, chloroma sarcoma, chorio carcinoma, embryonal sarcoma, Wilms' tumor sarcoma, endometrial sarcoma, stromal sarcoma, Ewing's sarcoma, fascial sarcoma, fibroblastic sarcoma, giant cell sarcoma, granulocytic sarcoma, Hodgkin's sarcoma, idiopathic multiple pigmented hemorrhagic sarcoma, immunoblastic sarcoma of B cells, lymphoma, immunoblastic sarcoma of T-cells, Jensen's sarcoma, Kaposi's sarcoma, Kupffer cell sarcoma, angiosarcoma, leukosarcoma, malignant mesenchymoma sarcoma, parosteal sarcoma, reticulocytic sarcoma, Rous sarcoma, serocystic sarcoma, synovial sarcoma, or telangiectaltic sarcoma.

The term "melanoma" refers to a tumor arising from the melanocytic system of the skin and other organs. Melanomas include, for example, acra-lentiginous melanoma, amelanotic melanoma, benign juvenile melanoma, Cloudman's melanoma, S91 melanoma, Harding-Passey melanoma, juvenile melanoma, lentigo maligna melanoma, malignant melanoma, metastatic melanoma, nodular melanoma, subungal melanoma, or superficial spreading melanoma.

The term "carcinoma" refers to a malignant new growth made up of epithelial cells tending to infiltrate the surrounding tissues and give rise to metastases. Exemplary carcinomas include, e.g., acinar carcinoma, acinous carcinoma, adenocystic carcinoma, adenoid cystic carcinoma, carcinoma adenomatosum, carcinoma of adrenal cortex, alveolar carcinoma, alveolar cell carcinoma, basal cell carcinoma, carcinoma basocellulare, basaloid carcinoma, basosquamous cell carcinoma, bronchioalveolar carcinoma, bronchiolar carcinoma, bronchogenic carcinoma, cerebriform carcinoma, cholangiocellular carcinoma, chorionic carcinoma, colloid carcinoma, comedo carcinoma, corpus carcinoma, cribriform carcinoma, carcinoma en cuirasse, carcinoma cutaneum, cylindrical carcinoma, cylindrical cell carcinoma, duct carcinoma, carcinoma durum, embryonal carcinoma, encephaloid carcinoma, epiermoid carcinoma, carcinoma epitheliale adenoides, exophytic carcinoma, carcinoma ex ulcere, carcinoma fibrosum, gelatiniform carcinoma, gelatinous carcinoma, giant cell carcinoma, carcinoma gigantocellulare, glandular carcinoma, granulosa cell carcinoma, hair-matrix carcinoma, hematoid carcinoma, hepatocellular carcinoma, Hurthle cell carcinoma, hyaline carcinoma, hypemephroid carcinoma, infantile embryonal carcinoma, carcinoma in situ, intraepidermal carcinoma, intraepithelial carcinoma, Krompecher's carcinoma, Kulchitzky-cell carcinoma, large-cell carcinoma, lenticular carcinoma, carcinoma lenticulare, lipomatous carcinoma, lymphoepithelial carcinoma, carcinoma medullare, medullary carcinoma, melanotic carcinoma, carcinoma molle, mucinous carcinoma, carcinoma muciparum, carcinoma mucocellulare, mucoepidernoid carcinoma, carcinoma mucosum, mucous carcinoma, carcinoma myxomatodes, naspharyngeal carcinoma, oat cell carcinoma, carcinoma ossificans, osteoid carcinoma, papillary carcinoma, periportal carcinoma, preinvasive carcinoma, prickle cell carcinoma, pultaceous carcinoma, renal cell carcinoma of kidney, reserve cell carcinoma, carcinoma sarcomatodes, schneiderian carcinoma, scirrhous carcinoma, carcinoma scroti, signet-ring cell carcinoma, carcinoma simplex, small-cell carcinoma, solanoid carcinoma, spheroidal cell carcinoma, spindle cell carcinoma, carcinoma spongiosum, squamous carcinoma, squamous cell carcinoma, string carcinoma, carcinoma telangiectaticum, carcinoma telangiectodes, transitional cell carcinoma, carcinoma tuberosum, tuberous carcinoma, verrucous carcinoma, or carcinoma viflosum.

Additional cancers that can be treated include, e.g., Leukemia, Hodgkin's Disease, Non-Hodgkin's Lymphoma, multiple myeloma, neuroblastoma, breast cancer, ovarian cancer, lung cancer, rhabdomyosarcoma, primary thrombocytosis, primary macroglobulinemia, small-cell lung tumors, primary brain tumors, stomach cancer, colon cancer, malignant pancreatic insulanoma, malignant carcinoid, urinary bladder cancer, premalignant skin lesions, testicular cancer, lymphomas, thyroid cancer, papillary thyroid cancer, neuroblastoma, neuroendocrine cancer, esophageal cancer, genitourinary tract cancer, malignant hypercalcemia, cervical cancer, endometrial cancer, adrenal cortical cancer, prostate cancer, Müllerian cancer, ovarian cancer, peritoneal cancer, fallopian tube cancer, or uterine papillary serous carcinoma.

2. Combination Therapy

The disclosure further includes a polynucleotide, e.g., mRNA, encoding a tethered IL-12 polypeptide or uses thereof as a combination therapy, i.e., with any other anti-cancer agent in combination.

In certain embodiments, the disclosure is directed to a polynucleotide, e.g., mRNA, encoding a tethered IL-12 polypeptide in combination with one or more anti-cancer agents or uses of the polynucleotide in combination with one or more anti-cancer agents to the subject. In one embodiment, the combination therapy can be a combination of the polynucleotide, e.g., mRNA, encoding IL-12 and one or more standard therapy. In another embodiment, the methods of the disclosure include two additional anti-cancer agents, three additional agents, four additional agents, etc. The additional anti-cancer agents can be a protein, e.g., an antibody, or a polynucleotide, e.g., mRNA. In some embodiments, the one or more anti-cancer agents are an mRNA. In certain embodiments, the one or more anti-cancer agents are a polynucleotide encoding a tumor antigen. In certain embodiments, the one or more anti-cancer agents are an mRNA encoding a tumor antigen. In other embodiments, the one or more anti-cancer agents are not a tumor antigen or an mRNA encoding a tumor antigen. In other embodiments, the one or more anti-cancer agents are a protein, e.g., an antibody.

In some embodiments, the one or more anti-cancer agents are an approved agent by the United States Food and Drug Administration. In other embodiments, the one or more anti-cancer agents are a pre-approved agent by the United States Food and Drug Administration.

One skilled in the art would also appreciate that alternative embodiments of the present disclosure include a combination therapy of a polynucleotide, e.g., mRNA, encoding a tethered IL-12 polypeptide and any other agents, e.g., an anti-PD-1 antibody, an anti-PD-L1 antibody, and/or an anti-CTLA-4 antibody. For example, the present disclosure encompasses combination therapy of (i) a polynucleotide (e.g., mRNA) encoding a tethered IL-12 polypeptide and a protein comprising an anti-PD-1 antibody or an anti-PD-L1 antibody; or (iii) a polynucleotide (e.g., mRNA) encoding a tethered IL-12 polypeptide and a second protein comprising an anti-CTLA-4 antibody.

In other embodiments, the additional agents can be formulated together with the polynucleotide encoding a tethered IL-12 polypeptide, e.g., mRNA, or separately. Moreover, even when formulated separately, the additional agents can be administered concurrently with the polynucleotide, e.g., mRNA, encoding a tethered IL-12 polypeptide or sequentially. In one embodiment, the polynucleotide, e.g., mRNA, encoding a tethered IL-12 polypeptide is administered prior to the second agent. In another embodiment, the polynucleotide, e.g., mRNA, encoding a tethered IL-12 polypeptide is administered after the second agent.

In certain embodiments, the additional agents, e.g., any antibody disclosed herein, are also administered intratumorally. In other embodiments, the second agents, e.g., any antibody disclosed herein, are administered via different routes, e.g., intravenously, subcutaneously, intraperitoneally, etc.

In some aspects, the subject for the present methods or compositions has been treated with one or more standard of care therapies. In other aspects, the subject for the present methods or compositions has not been responsive to one or more standard of care therapies or anti-cancer therapies. In one aspect, the subject has been previously treated with an IL-12 protein or an IL-12 DNA gene therapy. In another aspect, the subject is treated with an anti-PD-1 antagonist prior to the polynucleotide of the present disclosure. In another aspect, the subject has been treated with a monoclonal antibody that binds to PD-1 prior to the polynucleotide of the present disclosure. In another aspect, the subject has been treated with an anti-PD-1 monoclonal antibody therapy prior to the polynucleotide of the present methods or compositions.

In recent years, the introduction of immune checkpoint inhibitors for therapeutic purposes has revolutionized cancer treatment. Of interest are therapies featuring combinations of checkpoint inhibitors with other costimulatory or inhibitory molecules.

T cell regulation, i.e., activation or inhibition, is mediated via co-stimulatory or co-inhibitory signals. This interaction is exerted via ligand/receptor interaction. T cells harbor a myriad of both activating receptors, such as OX40, and inhibitory receptors (i.e., immune checkpoints) such as programmed death receptor 1 (PD-1) or cytotoxic T lymphocyte-associated protein 4 (CTLA-4) (Mellman et al. 2011 Nature.; 480:480-489). Activation of these immune checkpoints results in T cell deactivation and commandeering these pathways by tumor cells contributes to their successful immune escape.

Immune checkpoint inhibitors such as pembrolizumab or nivolumab, which target the interaction between programmed death receptor 1/programmed death ligand 1 (PD-1/PD-L1) and PD-L2, have been recently approved for the treatment of various malignancies and are currently being investigated in clinical trials for cancers including melanoma, head and neck squamous cell carcinoma (HNSCC). Data available from these trials indicate substantial activity accompanied by a favorable safety and toxicity profile in these patient populations.

For example, checkpoint inhibitors have been tested in clinical trials for the treatment of melanoma. In particular, phase III clinical trials have revealed that therapies such as ipilimumab and pembrolizumab, which target the CTLA-4 and PD-1 immune checkpoints, respectively, have raised the three-year survival of patients with melanoma to ~70%, and overall survival (>5 years) to ~30%.

Likewise, checkpoint inhibitors have been tested in clinical trials for the treatment of head and neck cancer. In preclinical studies, it had been shown that that 45-80% of HNSCC tumors express programmed death ligand 1 (PD-L1) (Zandberg et al. (2014) Oral Oncol. 50:627-632). Currently there are dozens of clinical trials evaluating the efficacy and safety of immune checkpoint inhibitors as monotherapy or in combination regimens in HNSCC. For example, clinical trials with PD 1, PD-L1, and CTLA-4 inhibitors are being tested in HNSCC. Data that the PD-1 antibody pembrolizumab might be effective in metastatic/recurrent (R/M) HNSCC patients were generated in the phase 1b Keynote-012 phase I/II trial (Cheng. ASCO 2015, oral presentation). More recently the data of the randomized CheckMate-141 phase III clinical trial were presented (Gillison. AACR 2016, oral presentation). This study investigated the efficacy of the monoclonal PD-1 antibody nivolumab given every 2 weeks in platinum-refractory R/M HNSCC patients. The study was stopped early due to superiority of the nivolumab arm of the study.

In one aspect, the subject has been previously treated with a PD-1 antagonist prior to the polynucleotide of the present disclosure. In another aspect, the subject has been treated with a monoclonal antibody that binds to PD-1 prior to the polynucleotide of the present disclosure. In another aspect, the subject has been treated with an anti-PD-1 monoclonal antibody therapy prior to the polynucleotide of the present methods or compositions. In other aspects, the anti-PD-1 monoclonal antibody therapy comprises nivolumab, pembrolizumab, pidilizumab, or any combination thereof. In another aspect, the subject has been treated with a monoclonal antibody that binds to PD-L1 prior to the polynucleotide of the present disclosure. In another aspect, the subject has been treated with an anti-PD-L1 monoclonal antibody therapy prior to the polynucleotide of the present methods or compositions. In other aspects, the anti-PD-L1 monoclonal antibody therapy comprises durvalumab, avelumab, MEDI473, BMS-936559, aezolizumab, or any combination thereof.

In some aspects, the subject has been treated with a CTLA-4 antagonist prior to treatment with the compositions of present disclosure. In another aspect, the subject has been previously treated with a monoclonal antibody that binds to CTLA-4 prior to the compositions of the present disclosure. In another aspect, the subject has been treated with an anti-CTLA-4 monoclonal antibody prior to the polynucleotide of the present disclosure. In other aspects, the anti-CTLA-4 antibody therapy comprises ipilimumab or tremelimumab.

In some aspects, the disclosure is directed to a method of treating cancer and/or a method of immunotherapy in a subject in need thereof comprising administering to the subject (e.g., intratumorally, intraperitoneally, or intravenously) the polynucleotide (e.g., RNA, e.g., mRNA) encoding a tethered IL-12 polypeptide in combination with a PD-L1 antagonist, e.g., an antibody or antigen-binding portion thereof that specifically binds to PD-L1, e.g., an anti-PD-L1 monoclonal antibody, e.g., an anti-PD-L1 monoclonal antibody comprises Durvalumab, Avelumab, MEDI473, BMS-936559, Atezolizumab, or any combination thereof.

In certain embodiments, the anti-PD-L1 antibody useful for the disclosure is MSB0010718C (also called Avelumab; See US 2014/0341917) or BMS-936559 (formerly 12A4 or MDX-1105) (see, e.g., U.S. Pat. No. 7,943,743; WO 2013/173223). In other embodiments, the anti-PD-L1 antibody is MPDL3280A (also known as RG7446) (see, e.g., Herbst et al. (2013) *J Clin Oncol* 31(suppl):3000. Abstract; U.S. Pat. No. 8,217,149), MEDI4736 (also called Durvalumab; Khleif (2013) In: Proceedings from the European Cancer Congress 2013; Sep. 27-Oct. 1, 2013; Amsterdam, The Netherlands.

In some aspects, the disclosure is directed to a method of treating cancer and/or a method of immunotherapy in a subject in need thereof comprising administering to the subject (e.g., intratumorally, intraperitoneally, or intravenously) the polynucleotide (e.g., RNA, e.g., mRNA) encoding a tethered IL-12 polypeptide, in combination with a PD-1 antagonist, e.g., an antibody or antigen-binding portion thereof that specifically binds to PD-1, e.g., an anti-PD-1 monoclonal antibody.

In one embodiment, the anti-PD-1 antibody (or an antigen-binding portion thereof) useful for the disclosure is pembrolizumab. Pembrolizumab (also known as "KEYTRUDA®", lambrolizumab, and MK-3475) is a humanized monoclonal IgG4 antibody directed against human cell surface receptor PD-1 (programmed death-1 or programmed cell death-1). Pembrolizumab is described, for example, in U.S. Pat. No. 8,900,587; see also http://www.cancer.gov/drugdictionary?cdrid=695789 (last accessed: Dec. 14, 2014). Pembrolizumab has been approved by the FDA for the treatment of relapsed or refractory melanoma and advanced NSCLC.

In another embodiment, the anti-PD-1 antibody useful for the disclosure is nivolumab. Nivolumab (also known as "OPDIVO®"; formerly designated 5C4, BMS-936558, MDX-1106, or ONO-4538) is a fully human IgG4 (S228P) PD-1 immune checkpoint inhibitor antibody that selectively prevents interaction with PD-1 ligands (PD-L1 and PD-L2), thereby blocking the down-regulation of antitumor T-cell functions (U.S. Pat. No. 8,008,449; Wang et al., 2014 *Cancer Immunol Res.* 2(9):846-56). Nivolumab has shown activity in a variety of advanced solid tumors including renal cell carcinoma (renal adenocarcinoma, or hypernephroma), melanoma, and non-small cell lung cancer (NSCLC) (Topalian et al., 2012a; Topalian et al., 2014; Drake et al., 2013; WO 2013/173223.

In other embodiments, the anti-PD-1 antibody is MEDI0680 (formerly AMP-514), which is a monoclonal antibody against the PD-1 receptor. MEDI0680 is described, for example, in U.S. Pat. No. 8,609,089B2 or in http://www.cancer.gov/drugdictionary?cdrid=756047 (last accessed Dec. 14, 2014).

In certain embodiments, the anti-PD-1 antibody is BGB-A317, which is a humanized monoclonal antibody. BGB-A317 is described in U.S. Publ. No. 2015/0079109.

In certain embodiments, a PD-1 antagonist is AMP-224, which is a B7-DC Fc fusion protein. AMP-224 is discussed in U.S. Publ. No. 2013/0017199 or in http://www.cancer.gov/publications/dictionaries/cancer-drug?cdrid=700595 (last accessed Jul. 8, 2015).

In other embodiments, the disclosure includes a method of treating cancer and/or a method of immunotherapy in a subject in need thereof comprising administering to the subject (e.g., intratumorally, intraperitoneally, or intravenously) the polynucleotide (e.g., RNA, e.g., mRNA) encoding a tethered IL-12 polypeptide together with an antibody or an antigen binding portion thereof that specifically binds to PD-1, e.g., an anti-PD-1 monoclonal antibody, e.g., an anti-PD-1 monoclonal antibody comprises Nivolumab, Pembrolizumab, Pidilizumab, or any combination thereof.

In other aspects, the disclosure is directed to a method of treating cancer and/or a method of immunotherapy in a subject in need thereof comprising administering to the subject (e.g., intratumorally, intraperitoneally, or intravenously) the polynucleotide (e.g., RNA, e.g., mRNA) encoding a tethered IL-12 polypeptide in combination with a CTLA-4 antagonist, e.g., an antibody or antigen-binding portion thereof that specifically binds to CTLA-4, e.g., an anti-CTLA-4 monoclonal antibody, e.g., an anti-CTLA-4 monoclonal antibody comprises Ipilimumab or Tremelimumab, or any combination thereof.

An exemplary clinical anti-CTLA-4 antibody is the human mAb 10D1 (now known as ipilimumab and marketed as YERVOY®) as disclosed in U.S. Pat. No. 6,984,720. Another anti-CTLA-4 antibody useful for the present methods is tremelimumab (also known as CP-675,206). Tremelimumab is human IgG2 monoclonal anti-CTLA-4 antibody. Tremelimumab is described in WO/2012/122444, U.S. Publ. No. 2012/263677, or WO Publ. No. 2007/113648 A2.

In some embodiments, the compositions disclosed herein comprise (i) a polynucleotide, e.g., mRNA, encoding a tethered IL-12 polypeptide and (ii) a polynucleotide, e.g., mRNA, encoding an antibody or an antigen binding portion thereof which specifically binds to CTLA-4 in a single formulation.

3. Interleukin-12 (IL-12)

IL-12 (also shown as IL12) is a pleiotropic cytokine, the actions of which create an interconnection between innate and adaptive immunity. IL-12 functions primarily as a 70 kDa heterodimeric protein consisting of two disulfide-linked p35 and p40 subunits. The precursor form of the IL-12 p40 subunit (NM_002187; P29460; also referred to as IL-12B, natural killer cell stimulatory factor 2, cytotoxic lymphocyte maturation factor 2) is 328 amino acids in length, while its mature form is 306 amino acids long. The precursor form of the IL-12 p35 subunit (NM_000882; P29459; also referred to as IL-12A, natural killer cell stimulatory factor 1, cytotoxic lymphocyte maturation factor 1) is 219 amino acids in length and the mature form is 197 amino acids long. Id. The genes for the IL-12 p35 and p40 subunits reside on different chromosomes and are regulated independently of each other. Gately, M K et al., *Annu Rev Immunol.* 16: 495-521 (1998). Many different immune cells (e.g., dendritic cells, macrophages, monocytes, neutrophils, and B cells) produce IL-12 upon antigenic stimuli. The active IL-12 heterodimer is formed following protein synthesis. Id.

IL-12 is composed of a bundle of four alpha helices. It is a heterodimeric cytokine encoded by two separate genes, IL-12A (p35) and IL-12B (p40). The active heterodimer (referred to as 'p70'), and a homodimer of p40 are formed following protein synthesis.

In some embodiments, the tethered IL-12 polypeptide of the present disclosure comprises IL-12A. In some embodiments, the tethered IL-12 polypeptide of the present disclosure comprises IL-12B. In some embodiments, the tethered IL-12 polypeptide of the present disclosure comprises both IL-12A and IL-12B.

In some embodiments, IL-12B is located N-terminal to IL-12A in the tethered IL-12 polypeptide of the present disclosure. In some embodiments, IL-12A is located N-terminal to IL-12B in the tethered IL-12 polypeptide of the present disclosure. The phrase "located N-terminal to" indicates location in a polypeptide with respect to other sequences in the polypeptide in relation to the N-terminus of the polypeptide. For example, IL-12B that is "N-terminal to" IL-12A means that IL-12B is located closer to the N-terminus of the tethered IL-12 polypeptide than IL-12A.

In some embodiments, the tethered IL-12 polypeptide of the present disclosure comprises a single polypeptide chain comprising IL-12B and IL-12A, which are fused directly to one another or are linked to one another by a linker (referred to herein as an "subunit linker"). Non-limiting examples of linkers are disclosed elsewhere herein.

In some embodiments, the tethered IL-12 polypeptide of the disclosure comprises IL-12A and/or IL-12B that is a variant, that is a functional fragment, or that contains a substitution, an insertion and/or an addition, a deletion, and/or a covalent modification with respect to a wild-type IL-12A or IL-12B sequence. In some embodiments, sequence tags (such as epitope tags, e.g., a V5 tag) or amino acids, can be added to the sequences encoded by the polynucleotides of the disclosure (e.g., at the N-terminal or C-terminal ends), e.g., for localization. In some embodiments, amino acid residues located at the carboxy, amino terminal, or internal regions of a polypeptide of the disclosure can optionally be deleted providing for fragments.

In some embodiments, the tethered IL-12 polypeptide encoded by a polynucleotide of the disclosure (e.g., a RNA, e.g., an mRNA) comprises a substitutional variant of an IL-12A and/or IL-12B sequence, which can comprise one, two, three or more than three substitutions. In some embodiments, the substitutional variant can comprise one or more conservative amino acids substitutions. In other embodiments, the variant is an insertional variant. In other embodiments, the variant is a deletional variant.

As recognized by those skilled in the art, IL-12 protein fragments, functional protein domains, variants, and homologous proteins (orthologs) are also considered to be within the scope of the IL-12 polypeptides of the disclosure. Nonlimiting examples of polypeptides encoded by the polynucleotides of the disclosure are set forth in SEQ ID NOs: 1, 3, 45, 48 and 49. For example, SEQ ID NOs: 1, 3, and 45 provide the amino acid sequence of human wild type IL-12.

4. Membrane Domains

The tethered IL-12 polypeptides of the disclosure comprise a membrane domain that tethers (i.e., anchors) the IL-12 polypeptide to a cell membrane (e.g., a transmembrane domain). In some embodiments, the tethered IL-12 polypeptides comprise a transmembrane domain. In some embodiments, the tethered IL-12 polypeptides comprise a transmembrane domain, and optionally an intracellular domain. In some embodiments, the tethered IL-12 polypeptides comprise a transmembrane domain and an intracellular domain.

In some embodiments, the membrane domain is from an integral membrane protein.

Integral membrane proteins can include, for example, integral polytopic proteins that contain a single-pass or multi-pass transmembrane domain that tethers the protein to a cell surface, including domains with hydrophobic α-helical or β-barrel (i.e., β-sheet) structures. The amino-terminus (i.e., N-terminus) of Type I integral membrane proteins is located in the extracellular space, while the carboxy-terminus (i.e., C-terminus) of Type II integral membrane proteins is located in the intracellular space.

In some embodiments, a tethered IL-12 polypeptide of the disclosure comprises a transmembrane domain from an integral polytopic protein. In some embodiments, a tethered IL-12 polypeptide of the disclosure comprises a transmembrane domain from a Type I integral membrane protein. In some embodiments, a tethered IL-12 polypeptide comprises a transmembrane domain from a Type II integral membrane protein.

In some embodiments, the transmembrane domain comprises an intracellular domain (i.e., a domain that is localized to the intracellular space of a cell, e.g., a domain that is localized to the cytoplasm of a cell). In some embodiments, an intracellular domain has been removed from the transmembrane domain. In some embodiments, the transmembrane domain comprises a membrane domain without an intracellular domain.

Integral membrane proteins can also include, for example, integral monotopic proteins that contain a membrane domain that does not span the entire cell membrane but that tethers the protein to a cell surface.

In some embodiments, a tethered IL-12 polypeptide of the disclosure comprises a membrane domain from an integral monotopic protein.

In some embodiments, the membrane domain is from a Cluster of Differentiation (CD) protein, CD8, CD80, CD4, a receptor, Platelet-Derived Growth Factor Receptor (PDGF-R), Interleukin-6 Receptor (IL-6R), transferrin receptor, Tumor Necrosis Factor (TNF) receptor, erythropoietin (EPO) receptor, a T Cell Receptor (TCR), TCR β-chain, a Fc receptor, FcγRII, FcεRI, an interferon receptor, type I interferon receptor, a growth factor, Stem Cell Factor (SCF), TNF-α, B7-1, Asialoglycoprotein, c-erbB-2, ICAM-1, an immunoglobulin, an IgG, an IgM, a viral glycoprotein, rabies virus glycoprotein, respiratory syncytial virus glycoprotein G (RSVG), vesicular stomatis virus glycoprotein (VSVG), a viral hemagglutinin (HA), influenza HA, vaccinia virus HA, or any combination thereof.

In some embodiments, the membrane domain is selected from the group consisting of: a CD8 transmembrane domain, a PDGF-R transmembrane domain, a CD80 transmembrane domain, and any combination thereof.

Exemplary transmembrane domains are set forth in SEQ ID NOs: 101-103.

In one embodiment, a membrane domain comprises a transmembrane domain of T-cell surface glycoprotein CD8 alpha chain (also known as CD8A or T-lymphocyte differentiation antigen T8/Leu-2), e.g., a transmembrane of UniProtKB-P01732. In some embodiments, the polynucleotide, e.g., mRNA, encoding a tethered IL-12, comprises a nucleotide sequence encoding a CD8 transmembrane polypeptide. In some embodiments, the polynucleotide, e.g., mRNA, encoding a tethered IL-12, comprises a nucleotide sequence encoding a CD8 transmembrane polypeptide as set forth in SEQ ID NO: 101.

In another embodiment, a membrane domain comprises a transmembrane domain of platelet-derived growth factor receptor beta (EC:2.7.10.1) (also known as PDGF-R-beta, PDGFR-beta, beta platelet-derived growth factor receptor, beta-type platelet-derived growth factor receptor, CD140 antigen-like family member B, platelet-derived growth factor receptor 1, PDGFR-1, or CD140b), e.g., a transmembrane domain of UniProtKB-P09619. In some embodiments, the polynucleotide, e.g., mRNA, encoding a tethered IL-12, comprises a nucleotide sequence encoding a PDGFR-beta transmembrane polypeptide. In some embodiments, the polynucleotide, e.g., mRNA, encoding a tethered IL-12, comprises a nucleotide sequence encoding a PDGFR-beta transmembrane polypeptide as set forth in SEQ ID NO: 102.

In other embodiments, a membrane domain comprises a transmembrane domain of T-lymphocyte activation antigen CD80 (also known as activation B7-1 antigen, BB1, CTLA-4 counter-receptor B7.1, or B7), e.g., a transmembrane domain of UniProtKB-P33681. In some embodiments, the polynucleotide, e.g., mRNA, encoding a tethered IL-12, comprises a nucleotide sequence encoding a CD80 transmembrane polypeptide. In some embodiments, the polynucleotide, e.g., mRNA, encoding a tethered IL-12, comprises a nucleotide sequence encoding a CD80 transmembrane polypeptide as set forth in SEQ ID NO: 103.

In some embodiments, the membrane domain in the tethered IL-12 polypeptide comprises an amino acid sequence at least about 50%, at least about 60%, at least about 70%, at least about 80%, at least about 90%, at least about 95%, at least about 99%, or about 100% identical to SEQ ID NO: 101, SEQ ID NO: 102, SEQ ID NO: 103, or any combination thereof. In other embodiments, the membrane domain in the tethered IL-12 polypeptide comprises an amino acid sequence set forth in SEQ ID NO: 101, SEQ ID NO: 102, or SEQ ID NO: 103 without one amino acid, two amino acids, three amino acids, four amino acids, five amino acids, six amino acids, seven amino acids, eight amino acids, or nine amino acids at the N terminus of SEQ ID NO: 101, SEQ ID NO: 102, or SEQ ID NO: 103 and/or without one amino acid, two amino acids, three amino acids, four amino acids, five amino acids, six amino acids, seven amino acids, eight amino acids, or nine amino acids at the C terminus of SEQ ID NO: 101, SEQ ID NO: 102, or SEQ ID NO: 103. In certain embodiments, the membrane domain in the tethered IL-12 polypeptide comprises SEQ ID NO: 101, SEQ ID NO: 102, SEQ ID NO: 103, or any combination thereof with one amino acid substitution, two amino acid substitutions, three amino acid substitutions, four amino acid substitutions, five amino acid substitutions, six amino acid substitutions, seven amino acid substitutions, eight amino acid substitutions, or nine amino acid substitutions, wherein the membrane domain is capable of tethering the IL-12 polypeptide on a cell membrane.

In some embodiments, the membrane domain comprises a transmembrane domain and an intracellular domain. In some embodiments, an intracellular domain is any oligopeptide or polypeptide known to act as a transmission signal in a cell. In some embodiments, the membrane domain comprises an intracellular domain to stabilize the tethered IL-12 polypeptide.

Intracellular domains useful in the methods and compositions of the present disclosure include at least those derived from any of the polypeptides in which transmembrane domains are derived, as described supra. For example, suitable intracellular domains include, but are not limited to, an intracellular domain derived from CD80, PDGFR, or any combination thereof.

In some embodiments, a membrane domain comprises an intracellular domain of platelet-derived growth factor receptor beta (EC:2.7.10.1) (also known as PDGF-R-beta, PDGFR-beta, beta platelet-derived growth factor receptor, beta-type platelet-derived growth factor receptor, CD140 antigen-like family member B, platelet-derived growth factor receptor 1, PDGFR-1, or CD140b), e.g., an intracellular domain of UniProtKB-P09619. In some embodiments, the polynucleotide, e.g., mRNA, encoding a tethered IL-12, comprises a nucleotide sequence encoding a PDGFR-beta intracellular polypeptide. In some embodiments, the polynucleotide, e.g., mRNA, encoding a tethered IL-12, comprises a nucleotide sequence encoding a PDGFR-beta intracellular polypeptide as set forth in SEQ ID NO: 226.

In some embodiments, a membrane domain comprises a truncated intracellular domain of PDGFR-beta. In some embodiments, a truncated intracellular domain of PDGFR-beta stabilizes the tethered IL-12 polypeptide compared to the wild-type PDGFR-beta intracellular domain. In some embodiments, the polynucleotide, e.g., mRNA, encoding a tethered IL-12, comprises a nucleotide sequence encoding a truncated PDGFR-beta intracellular polypeptide. In some embodiments, the polynucleotide, e.g., mRNA, encoding a tethered IL-12, comprises a nucleotide sequence encoding a truncated PDGFR-beta intracellular polypeptide as set forth in SEQ ID NO: 227. In some embodiments, the polynucleotide, e.g., mRNA, encoding a tethered IL-12, comprises a nucleotide sequence encoding a truncated PDGFR-beta intracellular polypeptide as set forth in SEQ ID NO: 228.

In other embodiments, a membrane domain comprises an intracellular domain of T-lymphocyte activation antigen CD80 (also known as activation B7-1 antigen, BB1, CTLA-4 counter-receptor B7.1, or B7), e.g., an intracellular domain of UniProtKB-P33681. In some embodiments, the polynucleotide, e.g., mRNA, encoding a tethered IL-12, comprises a nucleotide sequence encoding a CD80 intracellular polypeptide. In some embodiments, the polynucleotide, e.g., mRNA, encoding a tethered IL-12, comprises a nucleotide sequence encoding a CD80 intracellular polypeptide as set forth in SEQ ID NO: 225.

In some embodiments, the tethered IL-12 polypeptides described herein comprise a membrane domain comprising a transmembrane domain and an intracellular domain derived from the same polypeptide (i.e., homologous). In some embodiments, the tethered IL-12 polypeptides described herein comprise a membrane domain comprising a CD80 transmembrane domain and CD80 intracellular domain. In some embodiments, the tethered IL-12 polypeptide described herein comprise a membrane domain comprising a PDGFR-beta transmembrane domain and PDGFR-beta intracellular domain. In some embodiments, the tethered IL-12 polypeptides described herein comprise a membrane domain comprising a transmembrane domain and an intracellular domain derived from different polypeptides (i.e., heterologous) (e.g., a CD80 transmembrane domain and a PDGFR-beta intracellular domain; a CD8 transmembrane domain and a CD80 intracellular domain; a CD8 transmembrane domain and a PDGFR-beta transmembrane domain; or a PDGFR-beta transmembrane domain and a CD80 intracellular domain).

In some embodiments, the membrane domain (e.g., transmembrane domain, and optional intracellular domain) in the tethered IL-12 polypeptide is located C-terminal to any IL-12 amino acid sequence (i.e., any amino acid sequence of IL-12A, IL-12B, or both IL-12A and IL-12B when both are present in the tethered IL-12 polypeptide). The phrase "located C-terminal to" indicates location in a polypeptide with respect to other sequences in the polypeptide in relation to the C-terminus of the polypeptide. A membrane domain (e.g., transmembrane domain, and optional intracellular domain) that is "C-terminal to" any IL-12 amino acid sequences means that the membrane domain is located closer to the C-terminus of the tethered IL-12 polypeptide than any IL-12 amino acid sequences.

In some embodiments, the membrane domain (e.g., transmembrane domain, and optional intracellular domain) in the tethered IL-12 polypeptide is from a Type I integral membrane protein and is located C-terminal to any IL-12 amino acid sequence.

In some embodiments, the membrane domain (e.g., transmembrane domain, and optional intracellular domain) in the tethered IL-12 polypeptide is located N-terminal to the IL-12 polypeptide. A membrane domain that is "N-terminal to" any IL-12 amino acid sequences means that the membrane domain is located closer to the N-terminus of the tethered IL-12 polypeptide than any IL-12 amino acid sequences.

In some embodiments, the membrane domain (e.g., transmembrane domain, and optional intracellular domain) in the tethered IL-12 polypeptide is from a Type II integral membrane protein and is located N-terminal to any IL-12 amino acid sequence.

In some embodiments, the membrane domain (e.g., transmembrane domain, and optional intracellular domain) in the tethered IL-12 polypeptide is linked to the IL-12 polypeptide by a linker, which is referred to herein as a "membrane domain linker" or a "transmembrane domain linker" when the membrane domain is a transmembrane domain, and optionally an intracellular domain. Non-limiting examples of linkers are disclosed elsewhere herein. In some embodiments, the membrane domain in the tethered IL-12 polypeptide is fused directly to the IL-12 polypeptide.

5. Polynucleotides and Open Reading Frames (ORFs)

In certain aspects, the disclosure provides polynucleotides (e.g., a RNA, e.g., an mRNA) that comprise a nucleotide sequence encoding a tethered IL-12 polypeptide.

In one aspect, the disclosure provides polynucleotides (e.g., a RNA, e.g., an mRNA) comprising a nucleic acid sequence encoding an IL-12 polypeptide and a nucleic acid sequence encoding a membrane domain (e.g., transmembrane domain, and optional intracellular domain), wherein the nucleic acid sequence encoding the membrane domain is fused directly to the nucleic acid sequence encoding the IL-12 polypeptide or is linked to the nucleic acid sequence encoding the IL-12 polypeptide by a nucleic acid sequence encoding a linker (membrane domain linker).

In some aspects, the disclosure provides polynucleotides (e.g., a RNA, e.g., an mRNA) comprising a nucleic acid sequence encoding an IL-12 polypeptide, and a nucleic acid sequence encoding a transmembrane domain, wherein the nucleic acid sequence encoding the transmembrane domain is fused directly to the nucleic acid sequence encoding the IL-12 polypeptide or is linked to the nucleic acid sequence encoding the IL-12 polypeptide by a nucleic acid sequence encoding a linker (membrane domain linker).

In some aspects, the disclosure provides polynucleotides (e.g., a RNA, e.g., an mRNA) comprising a nucleic acid sequence encoding an IL-12 polypeptide, a nucleic acid sequence encoding a transmembrane domain, and a nucleic acid encoding an intracellular domain, wherein the nucleic acid sequence encoding the transmembrane domain is fused directly to the nucleic acid sequence encoding the IL-12 polypeptide or is linked to the nucleic acid sequence encoding the IL-12 polypeptide by a nucleic acid sequence encoding a linker (membrane domain linker), and wherein the nucleic acid encoding the intracellular domain is fused directly to the nucleic acid sequence encoding the transmembrane domain, or is linked to the nucleic acid sequence encoding the transmembrane domain by a nucleic acid sequence encoding a linker.

The skilled artisan will appreciate that it is possible to directly fuse domains within encoded chimeric proteins. As such it is possible to directly fuse domains by omitting linker sequences (e.g., omitting flexible linker-encoding sequences). For example, there are described herein constructs in which a membrane domain (e.g., a transmembrane domain, and optional intracellular domain) is directly fused to an interleukin domain or chain. As is shown herein, however, such constructions can lead to diminished interleukin activity as compared, for example, to corresponding constructs having flexible linker sequences included.

In some embodiments, the IL-12 polypeptide comprises an IL-12 p40 subunit (IL-12B), an IL-12A p35 subunit (IL-12A), or both.

In some embodiments, the nucleic acid sequence encoding the membrane domain (e.g., transmembrane domain, and optional intracellular domain) is located at the 3' terminus of the nucleic acid sequence encoding the IL-12 polypeptide or at the 3' terminus of the nucleic acid sequence encoding the membrane domain linker.

In some embodiments, the nucleic acid sequence encoding the membrane domain (e.g., transmembrane domain, and optional intracellular domain) is located at the 5' terminus of the nucleic acid sequence encoding the IL-12 polypeptide or at the 5' terminus of the nucleic acid sequence encoding the membrane domain linker.

In some embodiments, the polynucleotide comprises an open reading frame (ORF) comprising a nucleic acid sequence encoding IL-12B, a nucleic acid sequence encoding IL-12A, and a nucleic acid sequence encoding a membrane domain (e.g., transmembrane domain, and optional intracellular domain), wherein the ORF optionally comprises a nucleic acid sequence encoding a linker (subunit linker) that links the IL-12B and the IL-12A.

In some embodiments, the nucleic acid sequence encoding the IL-12B is located at the 5' terminus of the nucleic acid sequence encoding the IL-12A or at the 5' terminus of the nucleic acid sequence encoding the subunit linker.

In some embodiments, the nucleic acid sequence encoding the IL-12B is located at the 3' terminus of the nucleic acid sequence encoding the IL-12A or at the 3' terminus of the nucleic acid sequence encoding the subunit linker.

In some embodiments, the nucleic acid sequence encoding the membrane domain (e.g., transmembrane domain, and optional intracellular domain) is located at the 3' terminus of the nucleic acid sequence encoding the IL-12A or at the 3' terminus of the membrane domain linker.

In some embodiments, the nucleic acid sequence encoding the membrane domain (e.g., transmembrane domain, and optional intracellular domain) is located at the 5' terminus of the nucleic acid sequence encoding the IL-12B or at the 5' terminus of the membrane domain linker.

In some embodiments, the IL-12 polypeptide comprises an IL-12B polypeptide (i.e., IL-12B) selected from:

(a) the full-length IL-12B polypeptide (e.g., having the same or essentially the same length as wild-type IL-12B);

(b) a functional fragment of the wild-type IL-12B polypeptide (e.g., a truncated (e.g., deletion of carboxy, amino terminal, or internal regions) sequence shorter than an IL-12B wild-type; but still retaining IL-12B enzymatic activity);

(c) a variant thereof (e.g., full length or truncated IL-12B proteins in which one or more amino acids have been replaced, e.g., variants that retain all or most of the IL-12B activity of the polypeptide with respect to the wild type IL-12B polypeptide (such as, e.g., V33I, V298F, or any other natural or artificial variants known in the art); and (d) a fusion protein comprising (i) a full length IL-12B wild-type, a functional fragment or a variant thereof, and (ii) a heterologous protein.

In some embodiments, the IL-12 polypeptide comprises an IL-12A polypeptide (i.e., IL-12A) selected from:

(a) the full-length IL-12A polypeptide (e.g., having the same or essentially the same length as wild-type IL-12A);

(b) a functional fragment of the wild-type IL-12A polypeptide (e.g., a truncated (e.g., deletion of carboxy, amino terminal, or internal regions) sequence shorter than an IL-12A wild-type; but still retaining IL-12A enzymatic activity);

(c) a variant thereof (e.g., full length or truncated IL-12A proteins in which one or more amino acids have been replaced, e.g., variants that retain all or most of the IL-12A activity of the polypeptide with respect to the wtIL-12A polypeptide (such as natural or artificial variants known in the art); and (d) a fusion protein comprising (i) a full length IL-12A wild-type, a functional fragment or a variant thereof, and (ii) a heterologous protein.

In some embodiments, the membrane domain is selected from:

(a) the full-length membrane domain (e.g., having the same or essentially the same length as the wild-type membrane domain);

(b) a functional fragment of the wild-type membrane domain (e.g., a truncated (e.g., deletion of carboxy, amino terminal, or internal regions) sequence shorter than a membrane domain wild-type; but still retaining the ability of a membrane domain to tether a polypeptide to a cell membrane);

(c) a variant thereof (e.g., full length or truncated membrane domain proteins in which one or more amino acids have been replaced, e.g., variants that retain the ability of a membrane domain to tether a polypeptide to a cell membrane); and (d) a fusion protein comprising (i) a full length membrane domain wild-type, a functional fragment or a variant thereof, and (ii) a heterologous protein.

In certain embodiments, the polynucleotide (e.g., a RNA, e.g., an mRNA) of the disclosure comprises a nucleic acid sequence encoding a mammalian IL-12 polypeptide and/or membrane domain (e.g., a polypeptide comprising mammalian IL-12A, mammalian IL-12B, or both mammalian IL-12A and mammalian IL-12B), such as a human IL-12 polypeptide and/or membrane domain (e.g., a polypeptide comprising human IL-12A, human IL-12B, or both human IL-12A and human IL-12B), including a functional fragment or a variant thereof.

In some embodiments, the polynucleotide (e.g., a RNA, e.g., an mRNA) of the disclosure increases IL-12B and/or IL-12A protein expression levels and/or detectable IL-12 enzymatic activity levels in cells when introduced in those cells, e.g., by at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100%, compared to IL-12B and/or IL-12A protein expression levels and/or detectable IL-12 enzymatic activity levels in the cells prior to the administration of the polynucleotide of the disclosure. IL-12B and/or IL-12A protein expression levels and/or IL-12 enzymatic activity can be measured according to methods known in the art. In some embodiments, the polynucleotide is introduced to the cells in vitro. In some embodiments, the polynucleotide is introduced to the cells in vivo.

In some embodiments, the polynucleotides (e.g., a RNA, e.g., an mRNA) of the disclosure comprise a nucleotide sequence (e.g., an ORF comprising a nucleotide sequence) that encodes a wild-type human IL-12B and/or IL-12A.

In some embodiments, the polynucleotide (e.g., a RNA, e.g., an mRNA) of the disclosure comprises a codon optimized nucleic acid sequence, wherein the open reading frame (ORF) of the codon optimized nucleic sequence is derived from a wild-type IL-12A and/or IL-12B sequence.

In some embodiments, the polynucleotides (e.g., a RNA, e.g., an mRNA) of the disclosure comprise a nucleotide sequence encoding IL-12B and/or IL-12A having the full length sequence of human IL-12B and/or IL-12A (i.e., including the initiator methionine and the signal peptides). In mature human IL-12B and/or IL-12A, the initiator methionine and/or signal peptides can be removed to yield a "mature IL-12B" and/or "mature IL-12A" comprising amino acid residues of SEQ ID NO: 1 and SEQ ID NO: 3, respectively. SEQ ID NO: 1 corresponds to amino acids 23 to 328 of SEQ ID NO: 48, and SEQ ID NO: 3 corresponds to amino acids 336 to 532 of SEQ ID NO: 48. The teachings of the present disclosure directed to the full sequence of human IL-12B and/or IL-12A are also applicable to the mature form of human IL-12B and/or IL-12A lacking the initiator methionine and/or the signal peptide. Thus, in some embodiments, the polynucleotides (e.g., a RNA, e.g., an mRNA) of the disclosure comprise a nucleotide sequence encoding IL-12B and/or IL-12A having the mature sequence of human IL-12B and/or IL-12A. In some embodiments, the polynucleotide (e.g., a RNA, e.g., an mRNA) of the disclosure comprising a nucleotide sequence encoding IL-12B and/or IL-12A is sequence optimized.

In some embodiments, the polynucleotides (e.g., a RNA, e.g., an mRNA) of the disclosure comprise a nucleotide sequence (e.g., an ORF comprising a nucleotide sequence) encoding a tethered IL-12 polypeptide comprising a mutant IL-12B and/or IL-12A polypeptide. In some embodiments, the polynucleotides of the disclosure comprise an ORF comprising a nucleotide sequence encoding an IL-12B and/or IL-12A polypeptide that comprises at least one point mutation in the IL-12B and/or IL-12A sequence and retains IL-12B and/or IL-12A enzymatic activity. In some embodiments, the mutant IL-12B and/or IL-12A polypeptide has an IL-12B and/or IL-12A activity which is at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% of the IL-12B and/or IL-12A activity of the corresponding wild-type IL-12B and/or IL-12A (i.e., the same IL-12B and/or IL-12A but without the mutation(s)). In some embodiments, the polynucleotide (e.g., a RNA, e.g., an mRNA) of the disclosure comprising an ORF encoding a mutant IL-12B and/or IL-12A polypeptide is sequence optimized.

In some embodiments, the polynucleotide (e.g., a RNA, e.g., an mRNA) of the disclosure comprises a nucleotide sequence (e.g., an ORF comprising a nucleotide sequence) that encodes an IL-12B and/or IL-12A polypeptide with mutations that do not alter IL-12B and/or IL-12A enzymatic activity. Such mutant IL-12B and/or IL-12A polypeptides can be referred to as function-neutral. In some embodiments, the polynucleotide comprises an ORF comprising a nucleotide sequence that encodes a mutant IL-12B and/or IL-12A polypeptide comprising one or more function-neutral point mutations.

In some embodiments, the mutant IL-12B and/or IL-12A polypeptide has higher IL-12B and/or IL-12A enzymatic activity than the corresponding wild-type IL-12B and/or IL-12A. In some embodiments, the mutant IL-12B and/or IL-12A polypeptide has an IL-12B and/or IL-12A activity that is at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% higher than the activity of the corresponding wild-type IL-12B and/or IL-12A (i.e., the same IL-12B and/or IL-12A but without the mutation(s)).

In some embodiments, the polynucleotides (e.g., a RNA, e.g., an mRNA) of the disclosure comprise a nucleotide sequence (e.g., an ORF comprising a nucleotide sequence) encoding a functional IL-12B and/or IL-12A fragment, e.g., where one or more fragments correspond to a polypeptide subsequence of a wild type IL-12B and/or IL-12A polypeptide and retain IL-12B and/or IL-12A enzymatic activity. In some embodiments, the IL-12B and/or IL-12A fragment has an IL-12B and/or IL-12A activity which is at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% of the IL-12 activity of the corresponding full length IL-12B and/or IL-12A. In some embodiments, the polynucleotides (e.g., a RNA, e.g., an mRNA) of the disclosure comprising an ORF comprising a nucleotide sequence encoding a functional IL-12B and/or IL-12A fragment is sequence optimized.

In some embodiments, the polynucleotide (e.g., a RNA, e.g., an mRNA) of the disclosure comprises a nucleotide sequence (e.g., an ORF comprising a nucleotide sequence) encoding an IL-12B and/or IL-12A fragment that has higher IL-12B and/or IL-12A enzymatic activity than the corresponding full length IL-12B and/or IL-12A. Thus, in some embodiments the IL-12B and/or IL-12A fragment has an IL-12B and/or IL-12A activity which is at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 100% higher than the IL-12B and/or IL-12A activity of the corresponding full length IL-12B and/or IL-12A.

In some embodiments, the polynucleotide (e.g., a RNA, e.g., an mRNA) of the disclosure comprises a nucleotide sequence (e.g., an ORF comprising a nucleotide sequence) encoding an IL-12B and/or IL-12A fragment that is at least 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24% or 25% shorter than wild-type IL-12B and/or IL-12A.

In other embodiments, the polynucleotide (e.g., a RNA, e.g., an mRNA) of the disclosure comprises a nucleotide sequence (e.g., an ORF comprising a nucleotide sequence) encoding IL-12B, which has an amino acid sequence at least about 80%, at least about 90%, at least about 95%, at least 96%, at least 97%, at least 98%, at least 99%, or 100% identical to amino acids 23 to 328 of SEQ ID NO: 48, and wherein the amino acid sequence has IL-12B activity.

In other embodiments, the polynucleotide (e.g., a RNA, e.g., an mRNA) of the disclosure comprises a nucleotide sequence (e.g., an ORF comprising a nucleotide sequence) encoding IL-12A, which has an amino acid sequence at least about 80%, at least about 90%, at least about 95%, at least 96%, at least 97%, at least 98%, at least 99%, or 100% identical to amino acids 336 to 532 of SEQ ID NO:48, and wherein the amino acid sequence has IL-12A activity.

In other embodiments, the polynucleotide (e.g., a RNA, e.g., an mRNA) of the disclosure comprises a nucleotide sequence (e.g., an ORF comprising a nucleotide sequence) encoding IL-12B, which has:

(i) at least 70%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 67-984 of hIL12AB_001 to hIL12AB_003 (SEQ ID NOs: 5 to 7), hIL12AB_005 to hIL12AB_040 (SEQ ID NO: 9 to 44), or hIL12AB_041 (SEQ ID NO: 220); or (ii) at least 70%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 70-987 of hIL12AB_004 (SEQ ID NO: 8).

In other embodiments, the polynucleotide (e.g., a RNA, e.g., an mRNA) of the disclosure comprises a nucleotide sequence (e.g., an ORF comprising a nucleotide sequence) encoding IL-12A, which has:

(i) at least 70%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 1006-1596 of hIL12AB_001 to hIL12AB_003 (SEQ ID NOs: 5 to 7), hIL12AB_005 to hIL12AB_040 (SEQ ID NO: 9 to 44), or hIL12AB_041 (SEQ ID NO: 220); or (ii) at least 70%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to nucleotides 1009-1599 of hIL12AB_004 (SEQ ID NO: 4).

In some embodiments, the polynucleotide (e.g., a RNA, e.g., an mRNA) of the disclosure comprises a nucleotide sequence (e.g., an ORF) encoding an IL-12B-IL-12A fusion polypeptide (e.g., the wild-type sequence, functional fragment, or variant thereof), wherein the nucleotide sequence has at least 60%, at least 65%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from the group consisting of SEQ ID NOs: 5 to 44.

In some embodiments, the polynucleotide (e.g., a RNA, e.g., an mRNA) of the disclosure comprises a nucleotide sequence (e.g., an ORF comprising a nucleotide sequence) encoding an IL-12B-IL-12A fusion polypeptide (e.g., the wild-type sequence, functional fragment, or variant thereof), wherein the nucleotide sequence has 70% to 100%, 75% to 100%, 80% to 100%, 85% to 100%, 70% to 95%, 80% to 95%, 70% to 85%, 75% to 90%, 80% to 95%, 70% to 75%, 75% to 80%, 80% to 85%, 85% to 90%, 90% to 95%, or 95% to 100%, sequence identity to a sequence selected from the group consisting of SEQ ID NOs: 5 to 44 or 220.

In some embodiments, the polynucleotide (e.g., a RNA, e.g., an mRNA) encoding the IL-12 polypeptide comprises a nucleotide sequence at least 60%, at least 65%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to SEQ ID NO: 6 (hIL12AB_002).

In some embodiments, the polynucleotide (e.g., a RNA, e.g., an mRNA) encoding the IL-12 polypeptide comprises a nucleotide sequence at least 60%, at least 65%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to SEQ ID NO: 220 (hIL12AB_041).

In some embodiments, the polynucleotide (e.g., a RNA, e.g., an mRNA) of the disclosure comprises from about 900 to about 100,000 nucleotides (e.g., from 900 to 1,000, from 900 to 1,100, from 900 to 1,200, from 900 to 1,300, from 900 to 1,400, from 900 to 1,500, from 1,000 to 1,100, from 1,000 to 1,100, from 1,000 to 1,200, from 1,000 to 1,300, from 1,000 to 1,400, from 1,000 to 1,500, from 1,083 to 1,200, from 1,083 to 1,400, from 1,083 to 1,600, from 1,083 to 1,800, from 1,083 to 2,000, from 1,083 to 3,000, from 1,083 to 5,000, from 1,083 to 7,000, from 1,083 to 10,000, from 1,083 to 25,000, from 1,083 to 50,000, from 1,083 to 70,000, or from 1,083 to 100,000).

In some embodiments, the polynucleotide of the disclosure (e.g., a RNA, e.g., an mRNA) comprises a nucleotide sequence encoding an IL-12B-IL-12A fusion polypeptide (e.g., an ORF comprising a nucleotide sequence encoding IL-12B and a nucleotide encoding IL-12A; e.g., the wild-type sequence, functional fragment, or variant thereof encoding the IL-12B and/or IL-12A), wherein the length of the nucleotide sequence is at least 500 nucleotides in length (e.g., at least or greater than about 500, 600, 700, 80, 900, 1,000, 1,050, 1,083, 1,100, 1,200, 1,300, 1,400, 1,500, 1,600, 1,700, 1,800, 1,900, 2,000, 2,100, 2,200, 2,300, 2,400, 2,500, 2,600, 2,700, 2,800, 2,900, 3,000, 3,100, 3,200, 3,300, 3,400, 3,500, 3,600, 3,700, 3,800, 3,900, 4,000, 4,100, 4,200, 4,300, 4,400, 4,500, 4,600, 4,700, 4,800, 4,900, 5,000, 5,100, 5,200, 5,300, 5,400, 5,500, 5,600, 5,700, 5,800, 5,900, 6,000, 7,000, 8,000, 9,000, 10,000, 20,000, 30,000, 40,000, 50,000, 60,000, 70,000, 80,000, 90,000 or up to and including 100,000 nucleotides).

In one embodiment, the nucleic acid sequence encoding the IL-12B and the nucleic acid sequence encoding the IL-12A are fused directly to one another. In another embodiment, the nucleic acid sequence encoding the IL-12B and the nucleic acid sequence (encoding the IL-12A are linked by a nucleic acid sequence encoding a subunit linker.

In one embodiment, the nucleic acid sequence encoding the membrane domain is fused directly to the nucleic acid sequence encoding the IL-12 polypeptide comprising IL-12A, IL-12B, or IL-12A and IL-12B. In another embodiment, the nucleic acid sequence encoding the membrane domain is linked to the nucleic acid sequence encoding the IL-12 polypeptide comprising IL-12A, IL-12B, or IL-12A and IL-12B by a nucleic acid sequence encoding a membrane domain linker.

In some embodiments, the polynucleotide of the disclosure (e.g., a RNA, e.g., an mRNA) further comprises at least one nucleic acid sequence that is noncoding, e.g., a miRNA binding site.

In some embodiments, the polynucleotide of the disclosure (e.g., a RNA, e.g., an mRNA) is single stranded or double stranded.

In some embodiments, the polynucleotide of the disclosure is DNA or RNA. In some embodiments, the polynucleotide of the disclosure is RNA. In some embodiments, the polynucleotide of the disclosure is, or functions as, a messenger RNA (mRNA). In some embodiments, the mRNA comprises a nucleotide sequence that encodes IL-12B and/or IL-12A and a nucleic acid sequence encoding a membrane domain, and is capable of being translated to produce the encoded tethered IL-12 polypeptide in vitro, in vivo, in situ or ex vivo.

In some embodiments, the polynucleotide of the disclosure (e.g., a RNA, e.g., an mRNA) comprises a sequence-optimized nucleotide sequence encoding IL-12B and/or IL-12A (e.g., the wild-type sequence, functional fragment, or variant thereof encoding the IL-12B and/or the IL-12A) and/or a sequence-optimized nucleotide sequence encoding the membrane domain, wherein the polynucleotide comprises at least one chemically modified nucleobase, e.g., 5-methoxyuracil. In some embodiments, the polynucleotide further comprises a miRNA binding site, e.g., a miRNA binding site that binds to miR-122. In some embodiments, the polynucleotide disclosed herein is formulated with a delivery agent, e.g., a compound having Formula (I).

The polynucleotides (e.g., a RNA, e.g., an mRNA) of the disclosure can also comprise nucleotide sequences that encode additional features that facilitate trafficking of the encoded polypeptides to therapeutically relevant sites. One such feature that aids in protein trafficking is the signal sequence, or targeting sequence. The peptides encoded by these signal sequences are known by a variety of names, including targeting peptides, transit peptides, and signal peptides. In some embodiments, the polynucleotide (e.g., a RNA, e.g., an mRNA) comprises a nucleotide sequence (e.g., an ORF comprising a nucleotide sequence) that encodes a signal peptide operably linked a nucleotide sequence that encodes an IL-12B and/or IL-12A polypeptide described herein.

In some embodiments, the "signal sequence" or "signal peptide" is a polynucleotide or polypeptide, respectively, which is from about 9 to 200 nucleotides (3-70 amino acids) in length that, optionally, is incorporated at the 5' (or N-terminus) of the coding region or the polypeptide, respectively. Some signal peptides are cleaved from the protein, for example by a signal peptidase after the proteins are transported to the desired site.

In some embodiments, the polynucleotide (e.g., a RNA, e.g., an mRNA) of the disclosure comprises a nucleotide sequence encoding an IL-12B and/or IL-12A polypeptide, wherein the nucleotide sequence further comprises a 5' nucleic acid sequence encoding a native signal peptide. In another embodiment, the polynucleotide of the disclosure comprises a nucleotide sequence encoding an IL-12B and/or IL-12A polypeptide, wherein the nucleotide sequence lacks the nucleic acid sequence encoding a native signal peptide.

In some embodiments, the polynucleotide (e.g., a RNA, e.g., an mRNA) of the disclosure comprises a nucleotide sequence encoding an IL-12B and/or IL-12A polypeptide, wherein the nucleotide sequence further comprises a 5' nucleic acid sequence encoding a heterologous signal peptide.

In some embodiments, the polynucleotide (e.g., a RNA, e.g., an mRNA) further comprises a nucleic acid sequence encoding a signal peptide that is located at the 5' terminus of the nucleotide sequence encoding the IL-12B.

In some embodiments, the nucleotide sequence encoding the IL-12B comprises a nucleic acid sequence encoding a signal peptide.

In some embodiments, the signal peptide comprises a sequence at least about 80%, at least about 90%, at least about 95%, at least 96%, at least 97%, at least 98%, at least 99%, or 100% identical to amino acids 1 to 22 of SEQ ID NO: 48.

In some aspects, the disclosure provides mRNA comprising an open reading frame (ORF), wherein the ORF comprises a nucleotide sequence encoding from 5' to 3':
5'-[IL-12B]-[L1]-[IL-12A]-[L2]-[MD]-3', wherein
IL-12B is a human IL-12 p40 subunit polypeptide,
L1 is a first peptide linker,
IL-12A is a human IL-12 p35 subunit polypeptide,
L2 is a second peptide linker,
MD is a membrane domain comprising a transmembrane domain, and optionally an intracellular domain.

In some embodiments, the polynucleotide (e.g., mRNA) encoding a tethered IL-12 polypeptide comprises an open reading frame (ORF) encoding IL-12B, IL-12A, and a CD8 transmembrane domain, wherein the ORF optionally encodes a linker that links the IL-12B and the IL-12A, and wherein the ORF optionally encodes a linker that links the CD8 transmembrane domain and the IL-12B.

In some embodiments, the polynucleotide (e.g., mRNA) encoding a tethered IL-12 polypeptide comprises an open reading frame (ORF) encoding IL-12B, IL-12A, and a CD8 transmembrane domain, wherein the ORF optionally encodes a linker that links the IL-12B and the IL-12A, and wherein the ORF optionally encodes a linker that links the CD8 transmembrane domain and the IL-12A.

In some embodiments, the polynucleotide (e.g., mRNA) encoding a tethered IL-12 polypeptide comprises an open reading frame (ORF) encoding IL-12B, IL-12A, and a CD80 transmembrane domain, wherein the ORF optionally encodes a linker that links the IL-12B and the IL-12A, and wherein the ORF optionally encodes a linker that links the CD80 transmembrane domain and the IL-12B.

In some embodiments, the polynucleotide (e.g., mRNA) encoding a tethered IL-12 polypeptide comprises an open reading frame (ORF) encoding IL-12B, IL-12A, and a CD80 transmembrane domain, wherein the ORF optionally encodes a linker that links the IL-12B and the IL-12A, and wherein the ORF optionally encodes a linker that links the CD80 transmembrane domain and the IL-12A.

In some embodiments, the polynucleotide (e.g., mRNA) encoding a tethered IL-12 polypeptide comprises an open reading frame (ORF) encoding IL-12B, IL-12A, and a PDGFR-beta transmembrane domain, wherein the ORF optionally encodes a linker that links the IL-12B and the IL-12A, and wherein the ORF optionally encodes a linker that links the PDGFR-beta transmembrane domain and the IL-12B.

In some embodiments, the polynucleotide (e.g., mRNA) encoding a tethered IL-12 polypeptide comprises an open reading frame (ORF) encoding IL-12B, IL-12A, and a PDGFR-beta transmembrane domain, wherein the ORF optionally encodes a linker that links the IL-12B and the IL-12A, and wherein the ORF optionally encodes a linker that links the PDGFR-beta transmembrane domain and the IL-12A.

In some embodiments, the polynucleotide (e.g., mRNA) encoding a tethered IL-12 polypeptide comprises an open reading frame (ORF) encoding IL-12B, IL-12A, a CD80 transmembrane domain and intracellular domain, wherein the ORF optionally encodes a linker that links the IL-12B and the IL-12A, and wherein the ORF optionally encodes a linker that links the CD80 transmembrane domain and the IL-12B.

In some embodiments, the polynucleotide (e.g., mRNA) encoding a tethered IL-12 polypeptide comprises an open reading frame (ORF) encoding IL-12B, IL-12A, a CD80 transmembrane domain and intracellular domain, wherein the ORF optionally encodes a linker that links the IL-12B and the IL-12A, and wherein the ORF optionally encodes a linker that links the CD80 transmembrane domain and the IL-12A.

In some embodiments, the polynucleotide (e.g., mRNA) encoding a tethered IL-12 polypeptide comprises an open reading frame (ORF) encoding IL-12B, IL-12A, a PDGFR-beta transmembrane domain and intracellular domain, wherein the ORF optionally encodes a linker that links the IL-12B and the IL-12A, and wherein the ORF optionally encodes a linker that links the CD80 transmembrane domain and the IL-12B.

In some embodiments, the polynucleotide (e.g., mRNA) encoding a tethered IL-12 polypeptide comprises an open reading frame (ORF) encoding IL-12B, IL-12A, a PDGFR-beta transmembrane domain and intracellular domain, wherein the ORF optionally encodes a linker that links the IL-12B and the IL-12A, and wherein the ORF optionally encodes a linker that links the CD80 transmembrane domain and the IL-12A.

In some embodiments, the polynucleotide (e.g., mRNA) encoding a tethered IL-12 polypeptide comprises an open reading frame (ORF) encoding IL-12B, IL-12A, a PDGFR-beta transmembrane domain and truncated intracellular domain, wherein the ORF optionally encodes a linker that links the IL-12B and the IL-12A, and wherein the ORF optionally encodes a linker that links the CD80 transmembrane domain and the IL-12B.

In some embodiments, the polynucleotide (e.g., mRNA) encoding a tethered IL-12 polypeptide comprises an open reading frame (ORF) encoding IL-12B, IL-12A, a PDGFR-beta transmembrane domain and truncated intracellular domain, wherein the ORF optionally encodes a linker that links the IL-12B and the IL-12A, and wherein the ORF optionally encodes a linker that links the CD80 transmembrane domain and the IL-12A.

In some embodiments, the polynucleotide (e.g., mRNA) encoding a tethered IL-12 polypeptide comprises an open reading frame (ORF) encoding an IL-12 polypeptide comprising the amino acid sequence set forth in SEQ ID NO: 48, a linker comprising the amino acid sequence set forth in SEQ ID NO: 229, and a CD8 transmembrane domain comprising the amino acid sequence set forth in SEQ ID NO: 101.

In some embodiments, the polynucleotide (e.g., mRNA) encoding a tethered IL-12 polypeptide comprises an open reading frame (ORF) encoding an IL-12 polypeptide comprising the amino acid sequence set forth in SEQ ID NO: 48, a linker comprising the amino acid sequence set forth in SEQ ID NO: 229, and a CD80 transmembrane domain comprising the amino acid sequence set forth in SEQ ID NO: 103.

In some embodiments, the polynucleotide (e.g., mRNA) encoding a tethered IL-12 polypeptide comprises an open reading frame (ORF) encoding an IL-12 polypeptide comprising the amino acid sequence set forth in SEQ ID NO: 48, a linker comprising the amino acid sequence set forth in SEQ ID NO: 229, and a PDGFR-beta transmembrane domain comprising the amino acid sequence set forth in SEQ ID NO: 102.

In some embodiments, the polynucleotide (e.g., mRNA) encoding a tethered IL-12 polypeptide comprises an open reading frame (ORF) encoding an IL-12 polypeptide comprising the amino acid sequence set forth in SEQ ID NO: 48, a linker comprising the amino acid sequence set forth in SEQ ID NO: 229, a CD80 transmembrane domain comprising the amino acid sequence set forth in SEQ ID NO: 103, and a CD80 intracellular domain comprising the amino acid sequence set forth in SEQ ID NO: 225.

In some embodiments, the polynucleotide (e.g., mRNA) encoding a tethered IL-12 polypeptide comprises an open reading frame (ORF) encoding an IL-12 polypeptide comprising the amino acid sequence set forth in SEQ ID NO: 48, a linker comprising the amino acid sequence set forth in SEQ ID NO: 229, a CD80 transmembrane domain comprising the amino acid sequence set forth in SEQ ID NO: 103, and a truncated PDGFR-beta intracellular domain comprising the amino acid sequence set forth in SEQ ID NO: 227.

In some embodiments, the polynucleotide (e.g., mRNA) encoding a tethered IL-12 polypeptide comprises an open reading frame (ORF) encoding an IL-12 polypeptide comprising the amino acid sequence set forth in SEQ ID NO: 48, a linker comprising the amino acid sequence set forth in SEQ ID NO: 229, a CD80 transmembrane domain comprising the amino acid sequence set forth in SEQ ID NO: 103, and a truncated PDGFR-beta intracellular domain comprising the amino acid sequence set forth in SEQ ID NO: 228.

In some embodiments, the polynucleotide encoding a tethered IL-12 polypeptide is an mRNA comprising an open reading frame (ORF), comprising SEQ ID NO: 221, SEQ ID NO: 376, and SEQ ID NO: 377. In some embodiments, the polynucleotide encoding a tethered IL-12 polypeptide is an mRNA comprising a 5'UTR comprising SEQ ID NO: 287; an open reading frame (ORF), comprising SEQ ID NO: 221, SEQ ID NO: 376, and SEQ ID NO: 377; and a 3'UTR comprising SEQ ID NO: 283.

In some embodiments, the polynucleotide encoding a tethered IL-12 polypeptide is an mRNA comprising an open reading frame (ORF) comprising SEQ ID NO: 221, SEQ ID NO: 376, and SEQ ID NO: 378. In some embodiments, the polynucleotide encoding a tethered IL-12 polypeptide is an mRNA comprising a 5'UTR comprising SEQ ID NO: 287; an open reading frame (ORF) comprising SEQ ID NO: 221, SEQ ID NO: 376, and SEQ ID NO: 378; and a 3'UTR comprising SEQ ID NO: 283.

In some embodiments, the polynucleotide encoding a tethered IL-12 polypeptide is an mRNA comprising an open reading frame (ORF) comprising SEQ ID NO: 221, SEQ ID NO: 376, and SEQ ID NO: 250. In some embodiments, the polynucleotide encoding a tethered IL-12 polypeptide is an mRNA comprising a 5'UTR comprising SEQ ID NO: 287; an open reading frame (ORF) comprising SEQ ID NO: 221, SEQ ID NO: 376, and SEQ ID NO: 250; and a 3'UTR comprising SEQ ID NO: 283.

In some embodiments, the polynucleotide encoding a tethered IL-12 polypeptide is an mRNA comprising an open reading frame (ORF) comprising SEQ ID NO: 221, SEQ ID NO: 376, SEQ ID NO: 378 and SEQ ID NO: 379. In some embodiments, the polynucleotide encoding a tethered IL-12 polypeptide is an mRNA comprising a 5'UTR comprising SEQ ID NO: 287; an open reading frame (ORF) comprising SEQ ID NO: 221, SEQ ID NO: 376, SEQ ID NO: 378 and SEQ ID NO: 379; and a 3'UTR comprising SEQ ID NO: 283.

In some embodiments, the polynucleotide encoding a tethered IL-12 polypeptide is an mRNA comprising an open reading frame (ORF) comprising SEQ ID NO: 221, SEQ ID NO: 376, SEQ ID NO: 250 and SEQ ID NO: 251. In some embodiments, the polynucleotide encoding a tethered IL-12 polypeptide is an mRNA comprising a 5'UTR comprising SEQ ID NO: 287; an open reading frame (ORF) comprising SEQ ID NO: 221, SEQ ID NO: 376, SEQ ID NO: 250 and SEQ ID NO: 325; and a 3'UTR comprising SEQ ID NO: 283.

In some embodiments, the polynucleotide encoding a tethered IL-12 polypeptide is an mRNA comprising an open reading frame (ORF) comprising SEQ ID NO: 221, SEQ ID NO: 376, SEQ ID NO: 250 and SEQ ID NO: 280. In some embodiments, the polynucleotide encoding a tethered IL-12 polypeptide is an mRNA comprising a 5'UTR comprising SEQ ID NO: 287; an open reading frame (ORF) comprising SEQ ID NO: 221, SEQ ID NO: 376, SEQ ID NO: 250 and SEQ ID NO: 280; and a 3'UTR comprising SEQ ID NO: 283.

6. Chimeric Proteins

In some embodiments, the polynucleotide of the disclosure (e.g., a RNA, e.g., an mRNA) can comprise more than one nucleic acid sequence encoding one or more polypeptides. In some embodiments, polynucleotides of the disclosure comprise an a nucleic acid sequence encoding an IL-12 polypeptide comprising IL-12A and/or IL-12B and a nucleic acid sequence encoding a membrane domain, including functional fragments or a variants thereof (i.e., any or all of the IL-12A, IL-12B, or the membrane domain can be a functional fragment or variant). In some embodiments, the polynucleotide of the disclosure can comprise a nucleic acid sequence encoding IL-12B, a nucleic acid sequence encoding IL-12A, and a nucleic acid sequence encoding a membrane domain, including functional fragments or a variant thereof (i.e., any or all of the IL-12A, IL-12B, or the membrane domain can be a functional fragment or variant). In some embodiments, the polynucleotide of the disclosure can comprise one or more additional nucleic acid sequences expressing one or more additional polypeptides of interest (e.g., one or more additional nucleic acid sequences encoding one or more polypeptides heterologous to IL-12). In one embodiment, the additional polypeptide of interest can be fused to the IL-12B polypeptide directly or by a linker. In another embodiment, the additional polypeptide of interest can be fused to the IL-12A polypeptide directly or by a linker. In other embodiments, the additional polypeptide of interest can be fused to both the IL-12B polypeptide and the IL-12A polypeptide directly or by a linker. In other embodiments, the first additional polypeptide of interest is fused to the IL-12A polypeptide directly or by a linker, and the second additional polypeptide of interest is fused to the IL-12B polypeptide directly or by a linker. In some embodiments, two or more additional polypeptides of interest can be genetically fused, i.e., two or more additional polypeptides of interest can be encoded by the same ORF. In some embodiments, the polynucleotide can comprise a nucleic acid sequence encoding a linker (e.g., a $G_4S$ peptide linker or another linker known in the art) between two or more additional polypeptides of interest.

In some embodiments, the polynucleotide of the disclosure (e.g., a RNA, e.g., an mRNA) can comprise a nucleic acid sequence (e.g., one or more nucleic acid sequences) encoding an IL-12B polypeptide, IL-12A polypeptide, both IL-12B and IL-12A polypeptides, a nucleic acid sequence encoding a membrane domain, and one or more additional nucleic acid sequences encoding one or more additional polypeptides of interest.

7. Linker

In one aspect, the membrane domain can be fused directly to the IL-12 polypeptide of the present disclosure comprising IL-12A, IL-12B, and/or IL-12A and IL-12B or can be linked to the IL-12 polypeptide by a linker (referred to herein as the "membrane domain linker" or a "transmembrane domain linker" when the membrane domain is a transmembrane domain). In another aspect, IL-12B and IL-12A in an IL-12 polypeptide can be fused directly to one another or can be linked to one another by a linker (referred to herein as the "subunit linker"). In other embodiments, the IL-12B and/or IL-12A can be fused directly to a heterologous polypeptide or can be linked to the heterologous polypeptide by a linker (referred to herein as the "heterologous polypeptide linker."). In other embodiments, the membrane domain can be fused directly to a heterologous polypeptide or can be linked to the heterologous polypeptide by heterologous polypeptide linker. Suitable linkers can be a polypeptide (or peptide) moiety or a non-polypeptide moiety. In some embodiments, the linker is a peptide linker, including from one amino acid to about 200 amino acids. In some embodiments, the linker comprises at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, or at least 40 amino acids.

Without being bound in theory, it is believed that incorporation of linker-encoding sequences, (in particular, flexible linker-encoding sequences) between sequences (e.g., ORF sequences) encoding functional domains (e.g., interleukin chains, transmembrane domains, etc.) provide a certain degree of movement or interaction between domains, thus improving functionality of the mRNA-encoded chimeric (e.g., "tethered") interleukins of the disclosure. Flexible linkers are generally composed of small, non-polar (e.g., Gly) or polar (e.g., Ser) amino acids. The small size of these amino acids provides flexibility, and allows for mobility of the connected functional domains. Preferred flexible linkers encoded by sequences within the mRNAs of the disclosure have sequences consisting primarily of stretches of Gly and Ser residues ("GS" linker). An exemplary flexible linker has the sequence of (Gly-Gly-Gly-Gly-Ser)$_n$. By adjusting the copy number "n", the length of this GS linker can be optimized to achieve appropriate separation of the functional domains, or to maintain necessary inter-domain interactions. In some embodiments, the membrane domain linker is of sufficient length to prevent steric hindrance from the cell membrane.

In some embodiments, the linker can be a GS (Gly/Ser) linker, for example, comprising (G$_n$S)$_m$, wherein n is an integer from 1 to 100 and m is an integer from 1 to 100. In some embodiments, the Gly/Ser linker comprises (G$_n$S)$_m$ (SEQ ID NO: 193), wherein n is from 1 to 20, e.g., 1, 2 3, 4, 5, 6, 7, 8, 9, 10, 15, or 20 and m is from 1 to 20, e.g., 1, 2, 3, 4, 5, 6, 7, 8, 9, 10, 15, or 20. In some embodiments, the GS linker can comprise (GGGGS)$_o$ (SEQ ID NO: 194), wherein o is an integer from 1 to 5. In some embodiments, the GS linker can comprise GGSGGGGSGG (SEQ ID NO: 195), GGSGGGGG (SEQ ID NO: 196), or GSGSGSGS (SEQ ID NO: 197). In some embodiments, the GS linker comprises GGGGGGS (SEQ ID NO: 214).

In some embodiments, the linker suitable for the disclosure can be a Gly-rich linker, for example, comprising (Gly)$_p$ (SEQ ID NO: 198), wherein p is an integer from 1 to 100, e.g., from 1 to 40. In some embodiments, a Gly-rich linker can comprise GGGGG (SEQ ID NO: 192), GGGGGG (SEQ ID NO: 217), GGGGGGG (SEQ ID NO: 218) or GGGGGGGG (SEQ ID NO: 219).

In some embodiments, the linker suitable for the disclosure can comprise (EAAAK)$_q$ (SEQ ID NO: 199), wherein q is an integer from 1 to 100, e.g., from 1 to 20, e.g., from 1 to 5. In one embodiment, the linker suitable for the disclosure can comprise (EAAAK)$_3$.

Further exemplary linkers include, but not limited to, GGGGSLVPRGSGGGGS (SEQ ID NO: 200), GSGSGS (SEQ ID NO: 201), GGGGSLVPRGSGGGG (SEQ ID NO: 202), GGSGGHMGSGG (SEQ ID NO: 203), GGSGGSGGSGG (SEQ ID NO: 204), GGSGG (SEQ ID NO: 205), GSGSGSGS (SEQ ID NO: 206), GGGSEGGGSEGGGSEGGG (SEQ ID NO: 207), AAGAATAA (SEQ ID NO: 208), GGSSG (SEQ ID NO: 209), GSGGGTGGGSG (SEQ ID NO: 210), GSGSGSGGGSG (SEQ ID NO: 211), GSGGGSGSGGGSG (SEQ ID NO: 212), and GSGGGSGGSGGSGGS (SEQ ID NO: 213).

The nucleotides encoding the linkers can be constructed to fuse the sequences of the present disclosure. Based on the RNA sequences provided, a person of ordinary skill in the art would understand the corresponding DNA sequence (e.g., conversion of uracil to thymine). Likewise, based on the DNA sequences provided, a person of ordinary skill in the art would understand the corresponding RNA sequence (e.g., conversion of thymine to uracil).

8. Sequence Optimization of Nucleotide Sequence Encoding an IL-12 Polypeptide In some embodiments, the polynucleotide (e.g., a RNA, e.g., an mRNA) of the disclosure is sequence optimized. In some embodiments, the polynucleotide (e.g., a RNA, e.g., an mRNA) of the disclosure comprises a nucleotide sequence encoding an IL-12 polypeptide (i.e., an IL-12B and/or IL-12A polypeptide), a nucleotide sequence encoding a membrane domain, a nucleotide sequence encoding another polypeptide of interest, a 5'-UTR, a 3'-UTR, a miRNA, a nucleotide sequence encoding a linker (e.g., a membrane domain linker, a subunit linker, and/or a heterologous polypeptide linker), or any combination thereof that is sequence optimized.

A sequence-optimized nucleotide sequence (e.g., an codon-optimized mRNA sequence encoding an IL-12B and/or IL-12A polypeptide) is a sequence comprising at least one synonymous nucleobase substitution with respect to a reference sequence (e.g., a wild type nucleotide sequence encoding an IL-12B and/or IL-12A polypeptide).

A sequence-optimized nucleotide sequence can be partially or completely different in sequence from the reference sequence. For example, a reference sequence encoding polyserine uniformly encoded by TCT codons can be sequence-optimized by having 100% of its nucleobases substituted (for each codon, T in position 1 replaced by A, C in position 2 replaced by G, and T in position 3 replaced by C) to yield a sequence encoding polyserine which would be uniformly encoded by AGC codons. The percentage of sequence identity obtained from a global pairwise alignment between the reference polyserine nucleic acid sequence and the sequence-optimized polyserine nucleic acid sequence would be 0%. However, the protein products from both sequences would be 100% identical.

Some sequence optimization (also sometimes referred to as codon optimization) methods are known in the art (and discussed in more detail below) and can be useful to achieve one or more desired results. These results can include, e.g., matching codon frequencies in certain tissue targets and/or host organisms to ensure proper folding; biasing G/C content to increase mRNA stability or reduce secondary structures; minimizing tandem repeat codons or base runs that can impair gene construction or expression; customizing transcriptional and translational control regions; inserting or removing protein trafficking sequences; removing/adding post translation modification sites in an encoded protein (e.g., glycosylation sites); adding, removing or shuffling protein domains; inserting or deleting restriction sites; modifying ribosome binding sites and mRNA degradation sites; adjusting translational rates to allow the various domains of the protein to fold properly; and/or reducing or eliminating problem secondary structures within the polynucleotide. Sequence optimization tools, algorithms and services are known in the art, non-limiting examples include services from GeneArt (Life Technologies), DNA2.0 (Menlo Park Calif.) and/or proprietary methods. Codon options for each amino acid are given in Table 1.

TABLE 1

Codon Options

| Amino Acid | Single Letter Code | Codon Options |
|---|---|---|
| Isoleucine | I | ATT, ATC, ATA |
| Leucine | L | CTT, CTC, CTA, CTG, TTA, TTG |
| Valine | V | GTT, GTC, GTA, GTG |
| Phenylalanine | F | TTT, TTC |
| Methionine | M | ATG |
| Cysteine | C | TGT, TGC |
| Alanine | A | GCT, GCC, GCA, GCG |
| Glycine | G | GGT, GGC, GGA, GGG |
| Proline | P | CCT, CCC, CCA, CCG |
| Threonine | T | ACT, ACC, ACA, ACG |
| Serine | S | TCT, TCC, TCA, TCG, AGT, AGC |
| Tyrosine | Y | TAT, TAC |
| Tryptophan | W | TGG |
| Glutamine | Q | CAA, CAG |
| Asparagine | N | AAT, AAC |
| Histidine | H | CAT, CAC |
| Glutamic acid | E | GAA, GAG |
| Aspartic acid | D | GAT, GAC |
| Lysine | K | AAA, AAG |
| Arginine | R | CGT, CGC, CGA, CGG, AGA, AGG |
| Selenocysteine | Sec | UGA in mRNA in presence of Selenocysteine insertion element (SECIS) |
| Stop codons | Stop | TAA, TAG, TGA |

In some embodiments, a polynucleotide (e.g., a RNA, e.g., an mRNA) of the disclosure comprises a sequence-optimized nucleotide sequence encoding an IL-12 polypeptide, including a functional fragment or a variant thereof, or a sequence-optimized nucleotide sequence encoding a membrane domain, including a functional fragment or a variant thereof, wherein the IL-12 polypeptide and/or membrane domain encoded by the sequence-optimized nucleotide sequence has improved properties (e.g., compared to an IL-12 polypeptide, including a functional fragment or a variant thereof, or a membrane domain, including a functional fragment or a variant thereof, encoded by a reference nucleotide sequence that is not sequence optimized), e.g., improved properties related to expression efficacy after administration in vivo. Such properties include, but are not limited to, improving nucleic acid stability (e.g., mRNA stability), increasing translation efficacy in the target tissue, reducing the number of truncated proteins expressed, improving the folding or prevent misfolding of the expressed proteins, reducing toxicity of the expressed products, reducing cell death caused by the expressed products, increasing and/or decreasing protein aggregation.

In some embodiments, the sequence-optimized nucleotide sequence is codon optimized for expression in human subjects, having structural and/or chemical features that avoid one or more of the problems in the art, for example, features which are useful for optimizing formulation and delivery of nucleic acid-based therapeutics while retaining structural and functional integrity; overcoming a threshold of expression; improving expression rates; half-life and/or protein concentrations; optimizing protein localization; and avoiding deleterious bio-responses such as the immune response and/or degradation pathways.

In some embodiments, the polynucleotides of the disclosure comprise a nucleotide sequence (e.g., a nucleotide sequence encoding an IL-12 polypeptide, a nucleotide sequence encoding a membrane domain, a nucleotide sequence encoding an additional polypeptide of interest, a 5'-UTR, a 3'-UTR, a microRNA, a nucleic acid sequence encoding a linker, or any combination thereof) that is sequence-optimized according to a method comprising:

(i) substituting at least one codon in a reference nucleotide sequence (e.g., a nucleic acid sequence encoding an IL-12 polypeptide and/or a nucleic acid sequence encoding a membrane domain) with an alternative codon to increase or decrease uridine content to generate a uridine-modified sequence;

(ii) substituting at least one codon in a reference nucleotide sequence (e.g., a nucleic acid sequence encoding an IL-12 polypeptide and/or a nucleic acid sequence encoding a membrane domain) with an alternative codon having a higher codon frequency in the synonymous codon set;

(iii) substituting at least one codon in a reference nucleotide sequence (e.g., a nucleic acid sequence encoding an IL-12 polypeptide and/or a nucleic acid sequence encoding a membrane domain) with an alternative codon to increase G/C content; or (iv) a combination thereof.

In some embodiments, the sequence-optimized nucleotide sequence (e.g., a nucleic acid sequence encoding an IL-12 polypeptide and/or a nucleic acid sequence encoding a membrane domain) has at least one improved property with respect to the reference nucleotide sequence.

In some embodiments, the sequence optimization method is multiparametric and comprises one, two, three, four, or more methods disclosed herein and/or other optimization methods known in the art.

Features, which can be considered beneficial in some embodiments of the disclosure, can be encoded by or within regions of the polynucleotide and such regions can be upstream (5') to, downstream (3') to, or within the region that encodes the IL-12 polypeptide and/or the region that encodes membrane domain. These regions can be incorporated into the polynucleotide before and/or after sequence-optimization of the protein encoding region or open reading frame (ORF). Examples of such features include, but are not limited to, untranslated regions (UTRs), microRNA sequences, Kozak sequences, oligo(dT) sequences, poly-A tail, and detectable tags and can include multiple cloning sites that may have XbaI recognition.

In some embodiments, the polynucleotide of the disclosure comprises a 5' UTR, a 3' UTR and/or a miRNA. In some embodiments, the polynucleotide comprises two or more 5' UTRs and/or 3' UTRs, which can be the same or different sequences. In some embodiments, the polynucleotide comprises two or more miRNA, which can be the same or different sequences. Any portion of the 5' UTR, 3' UTR, and/or miRNA, including none, can be sequence-optimized and can independently contain one or more different structural or chemical modifications, before and/or after sequence optimization.

In some embodiments, after optimization, the polynucleotide is reconstituted and transformed into a vector such as, but not limited to, plasmids, viruses, cosmids, and artificial chromosomes. For example, the optimized polynucleotide can be reconstituted and transformed into chemically competent *E. coli*, yeast, *neurospora*, maize, *drosophila*, etc. where high copy plasmid-like or chromosome structures occur by methods described herein.

9. Sequence-Optimized Nucleotide Sequences Encoding IL-12 Polypeptides

In some embodiments, the polynucleotide of the disclosure comprises a sequence-optimized nucleotide sequence encoding an IL-12 polypeptide (i.e., an IL-12B and/or IL-12A polypeptide) disclosed herein. In some embodiments, the polynucleotide of the disclosure comprises a nucleic acid sequence encoding an IL-12B and/or a nucleic acid sequence encoding an IL-12A polypeptide and a nucleic acid sequence encoding a membrane domain, wherein the nucleic acid sequences have been sequence optimized.

Exemplary sequence-optimized nucleotide sequences encoding human IL-12B and/or IL-12A are set forth in SEQ ID NOs: 5-44, 98-100, 104-180, 220 and 221. In some embodiments, the sequence optimized IL-12B and/or IL-12A sequences set forth in SEQ ID NOs: 5-44, 98-100, 104-180, 220 and 221, fragments, and variants thereof are used to practice the methods disclosed herein. In some embodiments, the sequence optimized IL-12B and/or IL-12A sequences set forth in SEQ ID NOs: 5-44, 98-100, 104-180, 220 and 221, fragments and variants thereof are combined with or alternatives to the wild-type sequences disclosed in SEQ ID NOs: 1-6. Based on the RNA sequences provided, a person of ordinary skill in the art would understand the corresponding DNA sequence (e.g., conversion of uracil to thymine). Likewise, based on the DNA sequences provided, a person of ordinary skill in the art would understand the corresponding RNA sequence (e.g., conversion of thymine to uracil).

The sequence-optimized nucleotide sequences disclosed herein are distinct from the corresponding wild type nucleotide acid sequences and from other known sequence-optimized nucleotide sequences, e.g., these sequence-optimized nucleic acids have unique compositional characteristics.

10. Methods for Sequence Optimization

In some embodiments, a polynucleotide of the disclosure (e.g., a polynucleotide comprising a nucleotide sequence encoding an IL-12 polypeptide comprising IL-12A, IL-12B, or both IL-12A and IL-12B (e.g., the wild-type sequence, functional fragment, or variant thereof) and a membrane domain) is sequence optimized. A sequence optimized nucleotide sequence (nucleotide sequence is also referred to as "nucleic acid" herein) comprises at least one codon modification with respect to a reference sequence (e.g., a wild-type sequence encoding an IL-12 polypeptide comprising IL-12A, IL-12B, or both IL-12A and IL-12B or a membrane domain). Thus, in a sequence optimized nucleic acid, at least one codon is different from a corresponding codon in a reference sequence (e.g., a wild-type sequence).

In general, sequence optimized nucleic acids are generated by at least a step comprising substituting codons in a reference sequence with synonymous codons (i.e., codons that encode the same amino acid). Such substitutions can be effected, for example, by applying a codon substitution map (i.e., a table providing the codons that will encode each amino acid in the codon optimized sequence), or by applying a set of rules (e.g., if glycine is next to neutral amino acid, glycine would be encoded by a certain codon, but if it is next to a polar amino acid, it would be encoded by another codon). In addition to codon substitutions (i.e., "codon optimization") the sequence optimization methods disclosed herein comprise additional optimization steps which are not strictly directed to codon optimization such as the removal of deleterious motifs (destabilizing motif substitution). Compositions and formulations comprising these sequence optimized nucleic acids (e.g., a RNA, e.g., an mRNA) can be administered to a subject in need thereof to facilitate in vivo expression of functionally active IL-12.

The recombinant expression of large molecules in cell cultures can be a challenging task with numerous limitations (e.g., poor protein expression levels, stalled translation resulting in truncated expression products, protein misfolding, etc.) These limitations can be reduced or avoided by administering the polynucleotides (e.g., a RNA, e.g., an mRNA), which encode a functionally active IL-12 or compositions or formulations comprising the same to a patient suffering from cancer, so the synthesis and delivery of the IL-12 polypeptide to treat cancer takes place endogenously.

Changing from an in vitro expression system (e.g., cell culture) to in vivo expression requires the redesign of the nucleic acid sequence encoding the therapeutic agent. Redesigning a naturally occurring gene sequence by choosing different codons without necessarily altering the encoded amino acid sequence can often lead to dramatic increases in protein expression levels (Gustafsson et al., 2004, Journal/Trends Biotechnol 22, 346-53). Variables such as codon adaptation index (CAI), mRNA secondary structures, cis-regulatory sequences, GC content and many other similar variables have been shown to somewhat correlate with protein expression levels (Villalobos et al., 2006, "Journal/BMC Bioinformatics 7, 285). However, due to the degeneracy of the genetic code, there are numerous different nucleic acid sequences that can all encode the same therapeutic agent. Each amino acid is encoded by up to six synonymous codons; and the choice between these codons influences gene expression. In addition, codon usage (i.e., the frequency with which different organisms use codons for expressing a polypeptide sequence) differs among organisms (for example, recombinant production of human or humanized therapeutic antibodies frequently takes place in hamster cell cultures).

In some embodiments, a reference nucleic acid sequence can be sequence optimized by applying a codon map. The skilled artisan will appreciate that the T bases in the codon maps disclosed below are present in DNA, whereas the T bases would be replaced by U bases in corresponding RNAs. For example, a sequence optimized nucleic acid disclosed herein in DNA form, e.g., a vector or an in-vitro translation (IVT) template, would have its T bases transcribed as U based in its corresponding transcribed mRNA. In this respect, both sequence optimized DNA sequences (comprising T) and their corresponding RNA sequences (comprising U) are considered sequence optimized nucleic acid of the present disclosure. A skilled artisan would also understand that equivalent codon-maps can be generated by replaced one or more bases with non-natural bases. Thus, e.g., a TTC codon (DNA map) would correspond to a UUC codon (RNA map), which in turn may correspond to a ΨΨC codon (RNA map in which U has been replaced with pseudouridine).

In one embodiment, a reference sequence encoding IL-12A, IL-12B, or both IL-12A and IL-12B and/or a membrane domain can be optimized by replacing all the codons encoding a certain amino acid with only one of the alternative codons provided in a codon map. For example, all the valines in the optimized sequence would be encoded by GTG or GTC or GTT.

Sequence optimized polynucleotides of the disclosure can be generated using one or more codon optimization methods, or a combination thereof. Sequence optimization methods which may be used to sequence optimize nucleic acid sequences are described in detail herein. This list of methods is not comprehensive or limiting.

It will be appreciated that the design principles and rules described for each one of the sequence optimization methods discussed below can be combined in many different ways, for example high G/C content sequence optimization for some regions or uridine content sequence optimization for other regions of the reference nucleic acid sequence, as well as targeted nucleotide mutations to minimize secondary structure throughout the sequence or to eliminate deleterious motifs.

The choice of potential combinations of sequence optimization methods can be, for example, dependent on the specific chemistry used to produce a synthetic polynucleotide. Such a choice can also depend on characteristics of the protein encoded by the sequence optimized nucleic acid, e.g., a full sequence, a functional fragment, or a fusion protein comprising IL-12, etc. In some embodiments, such a choice can depend on the specific tissue or cell targeted by the sequence optimized nucleic acid (e.g., a therapeutic synthetic mRNA).

The mechanisms of combining the sequence optimization methods or design rules derived from the application and analysis of the optimization methods can be either simple or complex. For example, the combination can be:

(i) Sequential: Each sequence optimization method or set of design rules applies to a different subsequence of the overall sequence, for example reducing uridine at codon positions 1 to 30 and then selecting high frequency codons for the remainder of the sequence;

(ii) Hierarchical: Several sequence optimization methods or sets of design rules are combined in a hierarchical, deterministic fashion. For example, use the most GC-rich codons, breaking ties (which are common) by choosing the most frequent of those codons.

(iii) Multifactorial/Multiparametric: Machine learning or other modeling techniques are used to design a single sequence that best satisfies multiple overlapping and possibly contradictory requirements. This approach would require the use of a computer applying a number of mathematical techniques, for example, genetic algorithms.

Ultimately, each one of these approaches can result in a specific set of rules which in many cases can be summarized in a single codon table, i.e., a sorted list of codons for each amino acid in the target protein (i.e., an IL-12A polypeptide, an IL-12B polypeptide, both IL-12A and IL-12B polypeptides, and/or a membrane domain), with a specific rule or set of rules indicating how to select a specific codon for each amino acid position.

a. Codon Frequency—Codon Usage Bias

Numerous codon optimization methods known in the art are based on the substitution of codons in a reference nucleic acid sequence with codons having higher frequencies. Thus, in some embodiments, a nucleic acid sequence disclosed herein (e.g., a nucleic acid sequence encoding an IL-12 polypeptide and/or a nucleic acid sequence encoding a membrane domain) can be sequence optimized using methods comprising the use of modifications in the frequency of use of one or more codons relative to other synonymous codons in the sequence optimized nucleic acid with respect to the frequency of use in the non-codon optimized sequence.

As used herein, the term "codon frequency" refers to codon usage bias, i.e., the differences in the frequency of occurrence of synonymous codons in coding DNA/RNA. It is generally acknowledged that codon preferences reflect a balance between mutational biases and natural selection for translational optimization. Optimal codons help to achieve faster translation rates and high accuracy. As a result of these factors, translational selection is expected to be stronger in highly expressed genes. In the field of bioinformatics and computational biology, many statistical methods have been proposed and used to analyze codon usage bias. See, e.g., Comeron & Aguadé (1998) J. Mol. Evol. 47: 268-74. Methods such as the 'frequency of optimal codons' (Fop) (Ikemura (1981) J. Mol. Biol. 151 (3): 389-409), the Relative Codon Adaptation (RCA) (Fox & Eril (2010) DNA Res. 17 (3): 185-96) or the 'Codon Adaptation Index' (CAI) (Sharp & Li (1987) Nucleic Acids Res. 15 (3): 1281-95) are used to predict gene expression levels, while methods such as the 'effective number of codons' (Nc) and Shannon entropy from information theory are used to measure codon usage evenness. Multivariate statistical methods, such as correspondence analysis and principal component analysis, are widely used to analyze variations in codon usage among genes (Suzuki et al. (2008) DNA Res. 15 (6): 357-65; Sandhu et al., In Silico Biol. 2008; 8(2):187-92).

A nucleic acid sequence disclosed herein (e.g., a wild type nucleic acid sequence, a mutant nucleic acid sequence, a chimeric nucleic acid sequence, etc. which can be, for example, an mRNA), can be codon optimized using methods comprising substituting at least one codon in the reference nucleic acid sequence with an alternative codon having a higher or lower codon frequency in the synonymous codon set; wherein the resulting sequence optimized nucleic acid has at least one optimized property with respect to the reference nucleic acid sequence.

In some embodiments, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 99%, or 100% of the codons in the reference nucleic acid sequence are substituted with alternative codons, each alternative codon having a codon frequency higher than the codon frequency of the substituted codon in the synonymous codon set.

In some embodiments, at least one codon in the reference nucleic acid sequence is substituted with an alternative codon having a codon frequency higher than the codon frequency of the substituted codon in the synonymous codon set, and at least one codon in the reference nucleic acid sequence is substituted with an alternative codon having a codon frequency lower than the codon frequency of the substituted codon in the synonymous codon set.

In some embodiments, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, or at least about 75% of the codons in the reference nucleic acid sequence are substituted with alternative codons, each alternative codon having a codon frequency higher than the codon frequency of the substituted codon in the synonymous codon set.

In some embodiments, at least one alternative codon having a higher codon frequency has the highest codon frequency in the synonymous codon set. In other embodiments, all alternative codons having a higher codon frequency have the highest codon frequency in the synonymous codon set.

In some embodiments, at least one alternative codon having a lower codon frequency has the lowest codon frequency in the synonymous codon set. In some embodiments, all alternative codons having a higher codon frequency have the highest codon frequency in the synonymous codon set.

In some specific embodiments, at least one alternative codon has the second highest, the third highest, the fourth highest, the fifth highest or the sixth highest frequency in the synonymous codon set. In some specific embodiments, at least one alternative codon has the second lowest, the third lowest, the fourth lowest, the fifth lowest, or the sixth lowest frequency in the synonymous codon set.

Optimization based on codon frequency can be applied globally, as described above, or locally to the reference nucleic acid sequence. In some embodiments, when applied locally, regions of the reference nucleic acid sequence can modified based on codon frequency, substituting all or a certain percentage of codons in a certain subsequence with codons that have higher or lower frequencies in their respective synonymous codon sets. Thus, in some embodiments, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 99%, or 100% of the codons in a subsequence of the reference nucleic acid sequence are substituted with alternative codons, each alternative codon having a codon frequency higher than the codon frequency of the substituted codon in the synonymous codon set.

In some embodiments, at least one codon in a subsequence of the reference nucleic acid sequence is substituted with an alternative codon having a codon frequency higher than the codon frequency of the substituted codon in the synonymous codon set, and at least one codon in a subsequence of the reference nucleic acid sequence is substituted with an alternative codon having a codon frequency lower than the codon frequency of the substituted codon in the synonymous codon set.

In some embodiments, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, or at least about 75% of the codons in a subsequence of the reference nucleic acid sequence are substituted with alternative codons, each alternative codon having a codon frequency higher than the codon frequency of the substituted codon in the synonymous codon set.

In some embodiments, at least one alternative codon substituted in a subsequence of the reference nucleic acid sequence and having a higher codon frequency has the highest codon frequency in the synonymous codon set. In other embodiments, all alternative codons substituted in a subsequence of the reference nucleic acid sequence and having a lower codon frequency have the lowest codon frequency in the synonymous codon set.

In some embodiments, at least one alternative codon substituted in a subsequence of the reference nucleic acid sequence and having a lower codon frequency has the lowest codon frequency in the synonymous codon set. In some embodiments, all alternative codons substituted in a subsequence of the reference nucleic acid sequence and having a higher codon frequency have the highest codon frequency in the synonymous codon set.

In specific embodiments, a sequence optimized nucleic acid can comprise a subsequence having an overall codon frequency higher or lower than the overall codon frequency in the corresponding subsequence of the reference nucleic acid sequence at a specific location, for example, at the 5' end or 3' end of the sequence optimized nucleic acid, or within a predetermined distance from those region (e.g., at least 1, 2, 3, 4, 5, 6, 7, 8, 9, 10, 15, 20, 25, 30, 35, 40, 45, 50, 55, 60, 65, 70, 75, 80, 85, 90, 95 or 100 codons from the 5' end or 3' end of the sequence optimized nucleic acid).

In some embodiments, a sequence optimized nucleic acid can comprise more than one subsequence having an overall codon frequency higher or lower than the overall codon frequency in the corresponding subsequence of the reference nucleic acid sequence. A skilled artisan would understand that subsequences with overall higher or lower overall codon frequencies can be organized in innumerable patterns, depending on whether the overall codon frequency is higher or lower, the length of the subsequence, the distance between subsequences, the location of the subsequences, etc.

See, U.S. Pat. Nos. 5,082,767, 8,126,653, 7,561,973, 8,401,798; U.S. Publ. No. US 20080046192, US 20080076161; Int'l. Publ. No. WO2000018778; Welch et al. (2009) PLoS ONE 4(9): e7002; Gustafsson et al. (2012) Protein Expression and Purification 83: 37-46; Chung et al. (2012) BMC Systems Biology 6:134; all of which are incorporated herein by reference in their entireties.

b. Destabilizing Motif Substitution

There is a variety of motifs that can affect sequence optimization, which fall into various non-exclusive categories, for example:

(i) Primary sequence based motifs: Motifs defined by a simple arrangement of nucleotides.
(ii) Structural motifs: Motifs encoded by an arrangement of nucleotides that tends to form a certain secondary structure.
(iii) Local motifs: Motifs encoded in one contiguous subsequence.
(iv) Distributed motifs: Motifs encoded in two or more disjoint subsequences.
(v) Advantageous motifs: Motifs which improve nucleotide structure or function.
(vi) Disadvantageous motifs: Motifs with detrimental effects on nucleotide structure or function.

There are many motifs that fit into the category of disadvantageous motifs. Some examples include, for example, restriction enzyme motifs, which tend to be relatively short, exact sequences such as the restriction site motifs for XbaI (TCTAGA (SEQ ID NO: 187)), EcoRI (GAATTC (SEQ ID NO: 188)), EcoRII (CCWGG (SEQ ID NO: 189), wherein W means A or T, per the IUPAC ambiguity codes), or HindIII (AAGCTT (SEQ ID NO: 190)); enzyme sites, which tend to be longer and based on consensus not exact sequence, such in the T7 RNA polymerase (GnnnnWnCRnCTCnCnnWnD (SEQ ID NO: 191), wherein n means any nucleotide, R means A or G, W means A or T, D means A or G or T but not C); structural motifs, such as GGGG repeats (Kim et al. (1991) Nature 351(6324): 331-2); or other motifs such as CUG-triplet repeats (Querido et al. (2014) J. Cell Sci. 124:1703-1714).

Accordingly, a nucleic acid sequence disclosed herein can be sequence optimized using methods comprising substituting at least one destabilizing motif in a reference nucleic acid sequence, and removing such disadvantageous motif or replacing it with an advantageous motif.

In some embodiments, the optimization process comprises identifying advantageous and/or disadvantageous motifs in the reference nucleic sequence, wherein such motifs are, e.g., specific subsequences that can cause a loss of stability in the reference nucleic acid sequence prior or during the optimization process. For example, substitution of specific bases during optimization may generate a subsequence (motif) recognized by a restriction enzyme. Accordingly, during the optimization process the appearance of disadvantageous motifs can be monitored by comparing the sequence optimized sequence with a library of motifs known to be disadvantageous. Then, the identification of disadvantageous motifs could be used as a post-hoc filter, i.e., to determine whether a certain modification which potentially could be introduced in the reference nucleic acid sequence should be actually implemented or not.

In some embodiments, the identification of disadvantageous motifs can be used prior to the application of the sequence optimization methods disclosed herein, i.e., the identification of motifs in the reference nucleic acid sequence and their replacement with alternative nucleic acid sequences can be used as a preprocessing step, for example, before uridine reduction.

In other embodiments, the identification of disadvantageous motifs and their removal is used as an additional sequence optimization technique integrated in a multiparametric nucleic acid optimization method comprising two or more of the sequence optimization methods disclosed herein. When used in this fashion, a disadvantageous motif identified during the optimization process would be removed, for example, by substituting the lowest possible number of nucleobases in order to preserve as closely as possible the original design principle(s) (e.g., low U, high frequency, etc.).

See, e.g., U.S. Publ. Nos. US20140228558, US20050032730, or US20140228558, which are herein incorporated by reference in their entireties.

c. Limited Codon Set Optimization

In some particular embodiments, sequence optimization of a reference nucleic acid sequence can be conducted using a limited codon set, e.g., a codon set wherein less than the native number of codons is used to encode the 20 natural amino acids, a subset of the 20 natural amino acids, or an expanded set of amino acids including, for example, non-natural amino acids.

The genetic code is highly similar among all organisms and can be expressed in a simple table with 64 entries which would encode the 20 standard amino acids involved in protein translation plus start and stop codons. The genetic code is degenerate, i.e., in general, more than one codon specifies each amino acid. For example, the amino acid leucine is specified by the UUA, UUG, CUU, CUC, CUA, or CUG codons, while the amino acid serine is specified by UCA, UCG, UCC, UCU, AGU, or AGC codons (difference in the first, second, or third position). Native genetic codes comprise 62 codons encoding naturally occurring amino acids. Thus, in some embodiments of the methods disclosed herein optimized codon sets (genetic codes) comprising less than 62 codons to encode 20 amino acids can comprise 61, 60, 59, 58, 57, 56, 55, 54, 53, 52, 51, 50, 49, 48, 47, 46, 45, 44, 43, 42, 41, 40, 39, 38, 37, 36, 35, 34, 33, 32, 31, 30, 30, 29, 28, 27, 26, 25, 24, 23, 22, 21, or 20 codons.

In some embodiments, the limited codon set comprises less than 20 codons. For example, if a protein contains less than 20 types of amino acids, such protein could be encoded by a codon set with less than 20 codons. Accordingly, in some embodiments, an optimized codon set comprises as many codons as different types of amino acids are present in the protein encoded by the reference nucleic acid sequence. In some embodiments, the optimized codon set comprises 19, 18, 17, 16, 15, 14, 13, 12, 11, 10, 9, 8, 7, 6, 5, 4, 3, 2 or even 1 codon.

In some embodiments, at least one amino acid selected from the group consisting of Ala, Arg, Asn, Asp, Cys, Gln, Glu, Gly, His, Be, Leu, Lys, Phe, Pro, Ser, Thr, Tyr, and Val, i.e., amino acids which are naturally encoded by more than one codon, is encoded with less codons than the naturally occurring number of synonymous codons. For example, in some embodiments, Ala can be encoded in the sequence optimized nucleic acid by 3, 2 or 1 codons; Cys can be encoded in the sequence optimized nucleic acid by 1 codon; Asp can be encoded in the sequence optimized nucleic acid by 1 codon; Glu can be encoded in the sequence optimized nucleic acid by 1 codon; Phe can be encoded in the sequence optimized nucleic acid by 1 codon; Gly can be encoded in the sequence optimized nucleic acid by 3 codons, 2 codons or 1 codon; His can be encoded in the sequence optimized nucleic acid by 1 codon; Ile can be encoded in the sequence optimized nucleic acid by 2 codons or 1 codon; Lys can be encoded in the sequence optimized nucleic acid by 1 codon; Leu can be encoded in the sequence optimized nucleic acid by 5 codons, 4 codons, 3 codons, 2 codons or 1 codon; Asn can be encoded in the sequence optimized nucleic acid by 1 codon; Pro can be encoded in the sequence optimized nucleic acid by 3 codons, 2 codons, or 1 codon; Gln can be encoded in the sequence optimized nucleic acid by 1 codon; Arg can be encoded in the sequence optimized nucleic acid by 5 codons, 4 codons, 3 codons, 2 codons, or 1 codon; Ser can be encoded in the sequence optimized nucleic acid by 5 codons, 4 codons, 3 codons, 2 codons, or 1 codon; Thr can be encoded in the sequence optimized nucleic acid by 3 codons, 2 codons, or 1 codon; Val can be encoded in the sequence optimized nucleic acid by 3 codons, 2 codons, or 1 codon; and, Tyr can be encoded in the sequence optimized nucleic acid by 1 codon.

In some embodiments, at least one amino acid selected from the group consisting of Ala, Arg, Asn, Asp, Cys, Gln, Glu, Gly, His, Be, Leu, Lys, Phe, Pro, Ser, Thr, Tyr, and Val, i.e., amino acids which are naturally encoded by more than one codon, is encoded by a single codon in the limited codon set.

In some specific embodiments, the sequence optimized nucleic acid is a DNA and the limited codon set consists of 20 codons, wherein each codon encodes one of 20 amino acids. In some embodiments, the sequence optimized nucleic acid is a DNA and the limited codon set comprises at least one codon selected from the group consisting of GCT, GCC, GCA, and GCG; at least a codon selected from the group consisting of CGT, CGC, CGA, CGG, AGA, and AGG; at least a codon selected from AAT or ACC; at least a codon selected from GAT or GAC; at least a codon selected from TGT or TGC; at least a codon selected from CAA or CAG; at least a codon selected from GAA or GAG; at least a codon selected from the group consisting of GGT, GGC, GGA, and GGG; at least a codon selected from CAT or CAC; at least a codon selected from the group consisting of ATT, ATC, and ATA; at least a codon selected from the group consisting of TTA, TTG, CTT, CTC, CTA, and CTG; at least a codon selected from AAA or AAG; an ATG codon; at least a codon selected from TTT or TTC; at least a codon selected from the group consisting of CCT, CCC, CCA, and CCG; at least a codon selected from the group consisting of TCT, TCC, TCA, TCG, AGT, and AGC; at least a codon selected from the group consisting of ACT, ACC, ACA, and ACG; a TGG codon; at least a codon selected from TAT or TAC; and, at least a codon selected from the group consisting of GTT, GTC, GTA, and GTG.

In other embodiments, the sequence optimized nucleic acid is an RNA (e.g., an mRNA) and the limited codon set consists of 20 codons, wherein each codon encodes one of 20 amino acids. In some embodiments, the sequence optimized nucleic acid is an RNA and the limited codon set comprises at least one codon selected from the group consisting of GCU, GCC, GCA, and GCG; at least a codon selected from the group consisting of CGU, CGC, CGA, CGG, AGA, and AGG; at least a codon selected from AAU or ACC; at least a codon selected from GAU or GAC; at least a codon selected from UGU or UGC; at least a codon selected from CAA or CAG; at least a codon selected from GAA or GAG; at least a codon selected from the group consisting of GGU, GGC, GGA, and GGG; at least a codon selected from CAU or CAC; at least a codon selected from the group consisting of AUU, AUC, and AUA; at least a codon selected from the group consisting of UUA, UUG, CUU, CUC, CUA, and CUG; at least a codon selected from AAA or AAG; an AUG codon; at least a codon selected from UUU or UUC; at least a codon selected from the group consisting of CCU, CCC, CCA, and CCG; at least a codon selected from the group consisting of UCU, UCC, UCA, UCG, AGU, and AGC; at least a codon selected from the group consisting of ACU, ACC, ACA, and ACG; a UGG codon; at least a codon selected from UAU or UAC; and, at least a codon selected from the group consisting of GUU, GUC, GUA, and GUG.

In some specific embodiments, the limited codon set has been optimized for in vivo expression of a sequence optimized nucleic acid (e.g., a synthetic mRNA) following administration to a certain tissue or cell.

In some embodiments, the optimized codon set (e.g., a 20 codon set encoding 20 amino acids) complies at least with one of the following properties:
   (a) the optimized codon set has a higher average G/C content than the original or native codon set; or,
   (b) the optimized codon set has a lower average U content than the original or native codon set; or,
   (c) the optimized codon set is composed of codons with the highest frequency; or,
   (d) the optimized codon set is composed of codons with the lowest frequency; or,
   (e) a combination thereof.

In some specific embodiments, at least one codon in the optimized codon set has the second highest, the third highest, the fourth highest, the fifth highest or the sixth highest frequency in the synonymous codon set. In some specific embodiments, at least one codon in the optimized codon has the second lowest, the third lowest, the fourth lowest, the fifth lowest, or the sixth lowest frequency in the synonymous codon set.

As used herein, the term "native codon set" refers to the codon set used natively by the source organism to encode the reference nucleic acid sequence. As used herein, the term "original codon set" refers to the codon set used to encode the reference nucleic acid sequence before the beginning of sequence optimization, or to a codon set used to encode an optimized variant of the reference nucleic acid sequence at the beginning of a new optimization iteration when sequence optimization is applied iteratively or recursively.

In some embodiments, 5%, 10%, 15%, 20%, 25%, 30%, 35%, 40%, 45%, 50%, 55%, 60%, 65%, 70%, 75%, 80%, 85%, 90%, 95% or 100% of codons in the codon set are those with the highest frequency. In other embodiments, 5%, 10%, 15%, 20%, 25%, 30%, 35%, 40%, 45%, 50%, 55%, 60%, 65%, 70%, 75%, 80%, 85%, 90%, 95% or 100% of codons in the codon set are those with the lowest frequency.

In some embodiments, 5%, 10%, 15%, 20%, 25%, 30%, 35%, 40%, 45%, 50%, 55%, 60%, 65%, 70%, 75%, 80%, 85%, 90%, 95% or 100% of codons in the codon set are those with the highest uridine content. In some embodiments, 5%, 10%, 15%, 20%, 25%, 30%, 35%, 40%, 45%, 50%, 55%, 60%, 65%, 70%, 75%, 80%, 85%, 90%, 95% or 100% of codons in the codon set are those with the lowest uridine content.

In some embodiments, the average G/C content (absolute or relative) of the codon set is 5%, 10%, 15%, 20%, 25%, 30%, 35%, 40%, 45%, 50%, 55%, 60%, 65%, 70%, 75%, 80%, 85%, 90%, 95% or 100% higher than the average G/C content (absolute or relative) of the original codon set. In some embodiments, the average G/C content (absolute or relative) of the codon set is 5%, 10%, 15%, 20%, 25%, 30%, 35%, 40%, 45%, 50%, 55%, 60%, 65%, 70%, 75%, 80%, 85%, 90%, 95% or 100% lower than the average G/C content (absolute or relative) of the original codon set.

In some embodiments, the uracil content (absolute or relative) of the codon set is 5%, 10%, 15%, 20%, 25%, 30%, 35%, 40%, 45%, 50%, 55%, 60%, 65%, 70%, 75%, 80%, 85%, 90%, 95% or 100% higher than the average uracil content (absolute or relative) of the original codon set. In some embodiments, the uracil content (absolute or relative) of the codon set is 5%, 10%, 15%, 20%, 25%, 30%, 35%, 40%, 45%, 50%, 55%, 60%, 65%, 70%, 75%, 80%, 85%, 90%, 95% or 100% lower than the average uracil content (absolute or relative) of the original codon set.

See also U.S. Appl. Publ. No. 2011/0082055, and Int'l. Publ. No. WO2000018778, both of which are incorporated herein by reference in their entireties.

11. Characterization of Sequence Optimized Nucleic Acids

In some embodiments of the disclosure, the polynucleotide (e.g., a RNA, e.g., an mRNA) comprising a sequence optimized nucleic acid disclosed herein can be can be tested to determine whether at least one nucleic acid sequence property (e.g., stability when exposed to nucleases) or expression property has been improved with respect to the non-sequence optimized nucleic acid.

As used herein, "expression property" refers to a property of a nucleic acid sequence either in vivo (e.g., translation efficacy of a synthetic mRNA after administration to a subject in need thereof) or in vitro (e.g., translation efficacy of a synthetic mRNA tested in an in vitro model system). Expression properties include but are not limited to the amount of protein produced by an mRNA after administration, and the amount of soluble or otherwise functional protein produced. In some embodiments, sequence optimized nucleic acids disclosed herein can be evaluated according to the viability of the cells expressing a protein encoded by a sequence optimized nucleic acid sequence (e.g., a RNA, e.g., an mRNA) disclosed herein.

In a particular embodiment, a plurality of sequence optimized nucleic acids disclosed herein (e.g., a RNA, e.g., an mRNA) containing codon substitutions with respect to the non-optimized reference nucleic acid sequence can be characterized functionally to measure a property of interest, for example an expression property in an in vitro model system, or in vivo in a target tissue or cell.

a. Optimization of Nucleic Acid Sequence Intrinsic Properties

In some embodiments of the disclosure, the desired property of the polynucleotide is an intrinsic property of the nucleic acid sequence. For example, the nucleotide sequence (e.g., a RNA, e.g., an mRNA) can be sequence optimized for in vivo or in vitro stability. In some embodiments, the nucleotide sequence can be sequence optimized for expression in a particular target tissue or cell. In some embodiments, the nucleic acid sequence is sequence optimized to increase its plasma half by preventing its degradation by endo and exonucleases.

In other embodiments, the nucleic acid sequence is sequence optimized to increase its resistance to hydrolysis in solution, for example, to lengthen the time that the sequence optimized nucleic acid or a pharmaceutical composition comprising the sequence optimized nucleic acid can be stored under aqueous conditions with minimal degradation.

In other embodiments, the sequence optimized nucleic acid can be optimized to increase its resistance to hydrolysis in dry storage conditions, for example, to lengthen the time that the sequence optimized nucleic acid can be stored after lyophilization with minimal degradation.

b. Nucleic Acids Sequence Optimized for Protein Expression

In some embodiments of the disclosure, the desired property of the polynucleotide is the level of expression of an IL-12A polypeptide, an IL-12B polypeptide, or both IL-12A and IL-12B polypeptides and a membrane domain encoded by a sequence optimized sequence disclosed herein. Protein expression levels can be measured using one or more expression systems. In some embodiments, expression can be measured in cell culture systems, e.g., CHO cells or HEK293 cells. In some embodiments, expression can be measured using in vitro expression systems prepared from extracts of living cells, e.g., rabbit reticulocyte lysates, or in vitro expression systems prepared by assembly of purified individual components. In other embodiments, the protein expression is measured in an in vivo system, e.g., mouse, rabbit, monkey, etc.

In some embodiments, protein expression in solution form can be desirable. Accordingly, in some embodiments, a reference sequence can be sequence optimized to yield a sequence optimized nucleic acid sequence having optimized levels of expressed proteins in soluble form. Levels of protein expression and other properties such as solubility, levels of aggregation, and the presence of truncation products (i.e., fragments due to proteolysis, hydrolysis, or defective translation) can be measured according to methods known in the art, for example, using electrophoresis (e.g., native or SDS-PAGE) or chromatographic methods (e.g., HPLC, size exclusion chromatography, etc.).

c. Optimization of Target Tissue or Target Cell Viability

In some embodiments, the expression of heterologous therapeutic proteins encoded by a nucleic acid sequence can have deleterious effects in the target tissue or cell, reducing protein yield, or reducing the quality of the expressed product (e.g., due to the presence of protein fragments or precipitation of the expressed protein in inclusion bodies), or causing toxicity.

Accordingly, in some embodiments of the disclosure, the sequence optimization of a nucleic acid sequence disclosed herein, e.g., a nucleic acid sequence encoding an IL-12 polypeptide and/or a nucleic acid sequence encoding a membrane domain, can be used to increase the viability of target cells expressing the protein encoded by the sequence optimized nucleic acid.

Heterologous protein expression can also be deleterious to cells transfected with a nucleic acid sequence for autologous or heterologous transplantation. Accordingly, in some embodiments of the present disclosure the sequence optimization of a nucleic acid sequence disclosed herein can be used to increase the viability of target cells expressing the protein encoded by the sequence optimized nucleic acid sequence. Changes in cell or tissue viability, toxicity, and other physiological reaction can be measured according to methods known in the art.

d. Reduction of Immune and/or Inflammatory Response

In some cases, the administration of a sequence optimized nucleic acid encoding a tethered IL-12 polypeptide as disclosed herein, including functional fragments and variants thereof, may trigger an immune response, which could be caused by (i) the therapeutic agent (e.g., an mRNA comprising a nucleic acid sequence encoding a tethered IL-12 polypeptide), or (ii) the expression product of such therapeutic agent (e.g., the tethered IL-12 polypeptide encoded by the mRNA), or (iv) a combination thereof. Accordingly, in some embodiments of the present disclosure the sequence optimization of nucleic acid sequence (e.g., an mRNA) disclosed herein can be used to decrease an immune or inflammatory response triggered by the administration of a nucleic acid encoding a tethered IL-12 polypeptide or by the expression product of the tethered IL-12 polypeptide encoded by such nucleic acid.

In some aspects, an inflammatory response can be measured by detecting increased levels of one or more inflammatory cytokines using methods known in the art, e.g., ELISA. The term "inflammatory cytokine" refers to cytokines that are elevated in an inflammatory response. Examples of inflammatory cytokines include interleukin-6 (IL-6), CXCL1 (chemokine (C-X-C motif) ligand 1; also known as GROα, interferon-γ (IFNγ), tumor necrosis factor α (TNFα), interferon γ-induced protein 10 (IP-10), or granulocyte-colony stimulating factor (G-CSF). The term inflammatory cytokines includes also other cytokines associated with inflammatory responses known in the art, e.g., interleukin-1 (IL-1), interleukin-8 (IL-8), interleukin-13 (Il-13), interferon α (IFN-α), etc.

12. Methods for Modifying Polynucleotides

The disclosure includes modified polynucleotides comprising a polynucleotide described herein (e.g., a polynucleotide comprising a nucleotide sequence encoding an IL-12 polypeptide and a nucleotide sequence encoding a membrane domain). The modified polynucleotides can be chemically modified and/or structurally modified. When the polynucleotides of the present disclosure are chemically and/or structurally modified the polynucleotides can be referred to as "modified polynucleotides."

The present disclosure provides for modified nucleosides and nucleotides of a polynucleotide (e.g., RNA polynucleotides, such as mRNA polynucleotides) encoding a tethered IL-12 polypeptide. A "nucleoside" refers to a compound containing a sugar molecule (e.g., a pentose or ribose) or a derivative thereof in combination with an organic base (e.g., a purine or pyrimidine) or a derivative thereof (also referred to herein as "nucleobase"). A "nucleotide" refers to a nucleoside including a phosphate group. Modified nucleotides may by synthesized by any useful method, such as, for example, chemically, enzymatically, or recombinantly, to include one or more modified or non-natural nucleosides. Polynucleotides may comprise a region or regions of linked nucleosides. Such regions may have variable backbone linkages. The linkages may be standard phosphodiester linkages, in which case the polynucleotides would comprise regions of nucleotides.

The modified polynucleotides disclosed herein can comprise various distinct modifications. In some embodiments, the modified polynucleotides contain one, two, or more (optionally different) nucleoside or nucleotide modifications. In some embodiments, a modified polynucleotide, introduced to a cell may exhibit one or more desirable properties, e.g., improved protein expression, reduced immunogenicity, or reduced degradation in the cell, as compared to an unmodified polynucleotide.

a. Structural Modifications

In some embodiments, a polynucleotide of the present disclosure (e.g., a polynucleotide comprising a nucleotide sequence encoding an IL-12 polypeptide and a nucleotide sequence encoding a membrane domain) is structurally modified. As used herein, a "structural" modification is one in which two or more linked nucleosides are inserted, deleted, duplicated, inverted or randomized in a polynucleotide without significant chemical modification to the nucleotides themselves. Because chemical bonds will necessarily be broken and reformed to effect a structural modification, structural modifications are of a chemical nature and hence are chemical modifications. However, structural modifications will result in a different sequence of nucleotides. For example, the polynucleotide "ATCG" can be chemically modified to "AT-5meC-G". The same polynucleotide can be structurally modified from "ATCG" to "ATCCCG (SEQ ID NO: 215)". Here, the dinucleotide "CC" has been inserted, resulting in a structural modification to the polynucleotide.

b. Chemical Modifications

In some embodiments, the polynucleotides of the present disclosure (e.g., a polynucleotide comprising a nucleotide sequence encoding an IL-12 polypeptide and a nucleotide sequence encoding a membrane domain) are chemically modified. As used herein in reference to a polynucleotide, the terms "chemical modification" or, as appropriate, "chemically modified" refer to modification with respect to adenosine (A), guanosine (G), uridine (U), thymidine (T) or cytidine (C) ribo- or deoxyribonucleosides in one or more of their position, pattern, percent or population, including, but not limited to, its nucleobase, sugar, backbone, or any combination thereof. Generally, herein, these terms are not intended to refer to the ribonucleotide modifications in naturally occurring 5'-terminal mRNA cap moieties.

In some embodiments, the polynucleotides of the disclosure (e.g., a polynucleotide comprising a nucleotide sequence encoding an IL-12 polypeptide and a nucleotide sequence encoding a membrane domain) can have a uniform chemical modification of all or any of the same nucleoside type or a population of modifications produced by downward titration of the same starting modification in all or any of the same nucleoside type, or a measured percent of a chemical modification of all any of the same nucleoside type but with random incorporation, such as where all uridines are replaced by a uridine analog, e.g., 5-methoxyuridine. In another embodiment, the polynucleotides can have a uniform chemical modification of two, three, or four of the same nucleoside type throughout the entire polynucleotide (such as all uridines and/or all cytidines, etc. are modified in the same way).

Modified nucleotide base pairing encompasses not only the standard adenosine-thymine, adenosine-uracil, or guanosine-cytosine base pairs, but also base pairs formed between nucleotides and/or modified nucleotides comprising non-standard or modified bases, wherein the arrangement of hydrogen bond donors and hydrogen bond acceptors permits hydrogen bonding between a non-standard base and a standard base or between two complementary non-standard base structures. One example of such non-standard base pairing is the base pairing between the modified nucleotide inosine and adenine, cytosine or uracil. Any combination of base/sugar or linker may be incorporated into polynucleotides of the present disclosure.

The skilled artisan will appreciate that, except where otherwise noted, polynucleotide sequences set forth in the instant application will recite "T"s in a representative DNA sequence but where the sequence represents RNA, the "T"s would be substituted for "U"s.

Modifications of polynucleotides (e.g., RNA polynucleotides, such as mRNA polynucleotides) that are useful in the composition of the present disclosure include, but are not limited to the following: 2-methylthio-N6-(cis-hydroxyisopentenyl)adenosine; 2-methylthio-N6-methyladenosine; 2-methylthio-N6-threonyl carbamoyladenosine; N6-glycinylcarbamoyladenosine; N6-isopentenyladenosine; N6-methyladenosine; N6-threonylcarbamoyladenosine; 1,2'-O-dimethyladenosine; 1-methyladenosine; 2'-O-methyladenosine; 2'-O-ribosyladenosine (phosphate); 2-methyladenosine; 2-methylthio-N6 isopentenyladenosine; 2-methylthio-N6-hydroxynorvalyl carbamoyladenosine; 2'-O-methyladenosine; 2'-O-ribosyladenosine (phosphate); Isopentenyladenosine; N6-(cis-hydroxyisopentenyl)adenosine; N6,2'-O-dimethyladenosine; N6,2'-O-dimethyladenosine; N6,N6,2'-O-trimethyladenosine; N6,N6-dimethyladenosine; N6-acetyladenosine; N6-hydroxynorvalylcarbamoyladenosine; N6-methyl-N6-threonylcarbamoyladenosine; 2-methyladenosine; 2-methylthio-N6-isopentenyladenosine; 7-deazaadenosine; N1-methyl-adenosine; N6,N6 (dimethyl) adenine; N6-cis-hydroxy-isopentenyladenosine; α-thio-adenosine; 2 (amino) adenine; 2 (aminopropyl)adenine; 2 (methylthio) N6 (isopentenyl)adenine; 2-(alkyl) adenine; 2-(aminoalkyl) adenine; 2-(aminopropyl) adenine; 2-(halo) adenine; 2-(halo)adenine; 2-(propyl) adenine; 2'-Amino-2'-deoxy-ATP; 2'-Azido-2'-deoxy-ATP; 2'-Deoxy-2'-a-aminoadenosine TP; 2'-Deoxy-2'-a-azidoadenosine TP; 6 (alkyl)adenine; 6 (methyl)adenine; 6-(alkyl)adenine; 6-(methyl)adenine; 7 (deaza)adenine; 8 (alkenyl)adenine; 8 (alkynyl)adenine; 8 (amino)adenine; 8 (thioalkyl)adenine; 8-(alkenyl)adenine; 8-(alkyl)adenine; 8-(alkynyl)adenine; 8-(amino)adenine; 8-(halo)adenine; 8-(hydroxyl)adenine; 8-(thioalkyl)adenine; 8-(thiol)adenine; 8-azido-adenosine; aza adenine; deaza adenine; N6 (methyl)adenine; N6-(isopentyl) adenine; 7-deaza-8-aza-adenosine; 7-methyladenine; 1-Deazaadenosine TP; 2'Fluoro-N6-Bz-deoxyadenosine TP; 2'-OMe-2-Amino-ATP; 2'O-methyl-N6-Bz-deoxyadenosine TP; 2'-a-Ethynyladenosine TP; 2-aminoadenine; 2-Aminoadenosine TP; 2-Amino-ATP; 2'-a-Trifluoromethyl adenosine TP; 2-Azidoadenosine TP; 2'-b-Ethynyladenosine TP; 2-Bromoadenosine TP; 2'-b-Trifluoromethyladenosine TP; 2-Chloroadenosine TP; 2'-Deoxy-2',2'-difluoroadenosine TP; 2'-Deoxy-2'-a-mercaptoadenosine TP; 2'-Deoxy-2'-α-thiomethoxyadenosine TP; 2'-Deoxy-2'-b-aminoadenosine TP; 2'-Deoxy-2'-b-azidoadenosine TP; 2'-Deoxy-2'-b-bromoadenosine TP; 2'-Deoxy-2'-b-chloroadenosine TP; 2'-Deoxy-2'-b-fluoroadenosine TP; 2'-Deoxy-2'-b-iodoadenosine TP; 2'-Deoxy-2'-b-mercaptoadenosine TP; 2'-Deoxy-2'-b-thiomethoxyadenosine TP; 2-Fluoroadenosine TP; 2-Iodoadenosine TP; 2-Mercaptoadenosine TP; 2-methoxy-adenine; 2-methylthio-adenine; 2-Trifluoromethyladenosine TP; 3-Deaza-3-bromoadenosine TP; 3-Deaza-3-chloroadenosine TP; 3-Deaza-3-fluoroadenosine TP; 3-Deaza-3-iodoadenosine TP; 3-Deazaadenosine TP; 4'-Azidoadenosine TP; 4'-Carbocyclic adenosine TP; 4'-Ethynyladenosine TP; 5'-Homo-adenosine TP; 8-Aza-ATP; 8-bromo-adenosine TP; 8-Trifluoromethyladenosine TP; 9-Deazaadenosine TP; 2-aminopurine; 7-deaza-2,6-diaminopurine; 7-deaza-8-aza-2,6-diaminopurine; 7-deaza-8-aza-2-aminopurine; 2,6-diaminopurine; 7-deaza-8-aza-adenine, 7-deaza-2-aminopurine; 2-thiocytidine; 3-methylcytidine; 5-formylcytidine; 5-hydroxymethylcytidine; 5-methylcytidine; N4-acetylcytidine; 2'-O-methylcytidine; 2'-O-methylcytidine; 5,2'-O-dimethylcytidine; 5-formyl-2'-O-methylcytidine; Lysidine; N4,2'-O-dimethylcytidine; N4-acetyl-2'-O-methylcytidine; N4-methylcytidine; N4,N4-Dimethyl-2'-OMe-Cytidine TP; 4-methylcytidine; 5-aza-cytidine; Pseudoisocytidine; pyrrolo-cytidine; α-thio-cytidine; 2-(thio)cytosine; 2'-Amino-2'-deoxy-CTP; 2'-Azido-2'-deoxy-CTP; 2'-Deoxy-2'-a-aminocytidine TP; 2'-Deoxy-2'-a-azidocytidine TP; 3 (deaza) 5 (aza)cytosine; 3 (methyl)cytosine; 3-(alkyl)cytosine; 3-(deaza) 5 (aza)cytosine; 3-(methyl)cytidine; 4,2'-O-dimethylcytidine; 5 (halo)cytosine; 5 (methyl)cytosine; 5 (propynyl)cytosine; 5 (trifluoromethyl)cytosine; 5-(alkyl)cytosine; 5-(alkynyl)cytosine; 5-(halo)cytosine; 5-(propynyl)cytosine; 5-(trifluoromethyl)cytosine; 5-bromo-cytidine; 5-iodo-cytidine; 5-propynyl cytosine; 6-(azo)cytosine; 6-aza-cytidine; aza cytosine; deaza cytosine; N4 (acetyl) cytosine; 1-methyl-1-deaza-pseudoisocytidine; 1-methyl-pseudoisocytidine; 2-methoxy-5-methyl-cytidine; 2-methoxy-cytidine; 2-thio-5-methyl-cytidine; 4-methoxy-1-methyl-pseudoisocytidine; 4-methoxy-pseudoisocytidine; 4-thio-1-methyl-1-deaza-pseudoisocytidine; 4-thio-1-methyl-pseudoisocytidine; 4-thio-pseudoisocytidine; 5-azazebularine; 5-methyl-zebularine; pyrrolo-pseudoisocytidine; Zebularine; (E)-5-(2-Bromo-vinyl)cytidine TP; 2,2'-anhydro-cytidine TP hydrochloride; 2'Fluor-N4-Bz-cytidine TP; 2'Fluoro-N4-Acetyl-cytidine TP; 2'-O-Methyl-N4-Acetyl-cytidine TP; 2'O-methyl-N4-Bz-cytidine TP; 2'-a-Ethynylcytidine TP; 2'-a-Trifluoromethylcytidine TP; 2'-b-Ethynylcytidine TP; 2'-b-Trifluoromethylcytidine TP; 2'-Deoxy-2',2'-difluorocytidine TP; 2'-Deoxy-2'-a-mercaptocytidine TP; 2'-Deoxy-2'-α-thiomethoxycytidine TP; 2'-Deoxy-2'-b-aminocytidine TP; 2'-Deoxy-2'-b-azidocytidine TP; 2'-Deoxy-2'-b-bromocytidine TP; 2'-Deoxy-2'-b-chlorocytidine TP; 2'-Deoxy-2'-b-fluorocytidine TP; 2'-Deoxy-2'-b-iodocytidine TP; 2'-Deoxy-2'-b-mercaptocytidine TP; 2'-Deoxy-2'-b-thiomethoxycytidine TP; 2'-O-Methyl-5-(1-propynyl)cytidine TP; 3'-Ethynylcytidine TP; 4'-Azidocytidine TP; 4'-Carbocyclic cytidine TP; 4'-Ethynylcytidine TP; 5-(1-Propynyl)ara-cytidine TP; 5-(2-Chloro-phenyl)-2-thiocytidine TP; 5-(4-Amino-phenyl)-2-thiocytidine TP; 5-Aminoallyl-CTP; 5-Cyanocytidine TP; 5-Ethynylara-cytidine TP; 5-Ethynylcytidine TP; 5'-Homo-cytidine TP; 5-Methoxycytidine TP; 5-Trifluoromethyl-Cytidine TP; N4-Amino-cytidine TP; N4-Benzoyl-cytidine TP; Pseudoisocytidine; 7-methylguanosine; N2,2'-O-dimethylguanosine; N2-methylguanosine; Wyosine; 1,2'-O-dimethylguanosine; 1-methylguanosine; 2'-O-methylguanosine; 2'-O-ribosylguanosine (phosphate); 2'-O-methylguanosine; 2'-O-ribosylguanosine (phosphate); 7-aminomethyl-7-deazaguanosine; 7-cyano-7-deazaguanosine; Archaeosine; Methylwyosine; N2,7-dimethylguanosine; N2,N2,2'-O-trimethylguanosine; N2,N2,7-trimethylguanosine; N2,N2-dimethylguanosine; N2,7,2'-O-trimethylguanosine; 6-thio-guanosine; 7-deaza-guanosine; 8-oxo-guanosine; N1-methyl-guanosine; α-thio-guanosine; 2 (propyl)guanine; 2-(alkyl)guanine; 2'-Amino-2'-deoxy-GTP; 2'-Azido-2'-deoxy-GTP; 2'-Deoxy-2'-a-aminoguanosine TP; 2'-Deoxy-2'-a-azidoguanosine TP; 6 (methyl)guanine; 6-(alkyl)guanine; 6-(methyl)guanine; 6-methyl-guanosine; 7 (alkyl)guanine; 7 (deaza)guanine; 7 (methyl)guanine; 7-(alkyl)guanine; 7-(deaza)guanine; 7-(methyl)guanine; 8 (alkyl)guanine; 8 (alkynyl)guanine; 8 (halo)guanine; 8 (thioalkyl)guanine; 8-(alkenyl)guanine; 8-(alkyl)guanine; 8-(alkynyl)guanine; 8-(amino)guanine; 8-(halo)guanine; 8-(hydroxyl)guanine; 8-(thioalkyl)guanine; 8-(thiol)guanine; aza guanine; deaza guanine; N (methyl)guanine; N-(methyl)guanine; 1-methyl-6-thio-guanosine; 6-methoxy-guanosine; 6-thio-7-deaza-8-aza-guanosine; 6-thio-7-deaza-guanosine; 6-thio-7-methyl-guanosine; 7-deaza-8-aza-guanosine; 7-methyl-8-oxo-guanosine; N2,N2-dimethyl-6-thio-guanosine; N2-methyl-6-thio-guanosine; 1-Me-GTP; 2'Fluoro-N2-isobutyl-guanosine TP; 2'O-methyl-N2-isobutyl-guanosine TP; 2'-a-Ethynylguanosine TP; 2'-a-Trifluoromethylguanosine TP; 2'-b-Ethynylguanosine TP; 2'-b-Trifluoromethylguanosine TP; 2'-Deoxy-2',2'-difluoroguanosine TP; 2'-Deoxy-2'-a-mercaptoguanosine TP; 2'-Deoxy-2'-α-thiomethoxyguanosine TP; 2'-Deoxy-2'-b-aminoguanosine TP; 2'-Deoxy-2'-b-azidoguanosine TP; 2'-Deoxy-2'-b-bromoguanosine TP; 2'-Deoxy-2'-b-chloroguanosine TP; 2'-Deoxy-2'-b-fluoroguanosine TP; 2'-Deoxy-2'-b-iodoguanosine TP; 2'-Deoxy-2'-b-mercaptoguanosine TP; 2'-Deoxy-2'-b-thiomethoxyguanosine TP; 4'-Azidoguanosine TP; 4'-Carbocyclic guanosine TP; 4'-Ethynylguanosine TP; 5'-Homo-guanosine TP; 8-bromoguanosine TP; 9-Deazaguanosine TP; N2-isobutyl guanosine TP; 1-methylinosine; Inosine; 1,2'-O-dimethylinosine; 2'-O-methylinosine; 7-methylinosine; 2'-O-methylinosine; Epoxyqueuosine; galactosyl-queuosine; Mannosylqueuosine; Queuosine; allyamino-thymidine; aza thymidine; deaza thymidine; deoxy-thymidine; 2'-O-methyluridine; 2-thiouridine; 3-methyluridine; 5-carboxymethyluridine; 5-hydroxyuridine; 5-methyluridine; 5-taurinomethyl-2-thiouridine; 5-taurinomethyluridine; Dihydrouridine; Pseudouridine; (3-(3-amino-3-carboxypropyl)uridine; 1-methyl-3-(3-amino-5-carboxypropyl)pseudouridine; 1-methylpseduouridine; 1-methyl-pseudouridine; 2'-O-methyluridine; 2'-O-methylpseudouridine; 2'-O-methyluridine; 2-thio-2'-O-methyluridine; 3-(3-amino-3-carboxypropyl)uridine; 3,2'-O-dimethyluridine; 3-Methyl-pseudo-Uridine TP; 4-thiouridine; 5-(carboxyhydroxymethyl)uridine; 5-(carboxyhydroxymethyl)uridine methyl ester; 5,2'-O-dimethyluridine; 5,6-dihydro-uridine; 5-aminomethyl-2-thiouridine; 5-carbamoylmethyl-2'-O-methyluridine; 5-carbamoylmethyluridine; 5-carboxyhydroxymethyluridine; 5-carboxyhydroxymethyluridine methyl ester; 5-carboxymethylaminomethyl-2'-O-methyluridine; 5-carboxymethylaminomethyl-2-thiouridine; 5-carboxymethylaminomethyl-2-thiouridine;

5-carboxymethylaminomethyluridine; 5-carboxymethylaminomethyluridine; 5-Carbamoylmethyluridine TP; 5-methoxycarbonylmethyl-2'-O-methyluridine; 5-methoxycarbonylmethyl-2-thiouridine; 5-methoxycarbonylmethyluridine; 5-methyluridine), 5-methoxyuridine; 5-methyl-2-thiouridine; 5-methylaminomethyl-2-selenouridine; 5-methylaminomethyl-2-thiouridine; 5-methylaminomethyluridine; 5-Methyldihydrouridine; 5-Oxyacetic acid-Uridine TP; 5-Oxyacetic acid-methyl ester-Uridine TP; N1-methyl-pseudouridine; uridine 5-oxyacetic acid; uridine 5-oxyacetic acid methyl ester; 3-(3-Amino-3-carboxypropyl)-Uridine TP; 5-(iso-Pentenylaminomethyl)-2-thiouridine TP; 5-(iso-Pentenylaminomethyl)-2'-O-methyluridine TP; 5-(iso-Pentenylaminomethyl)uridine TP; 5-propynyl uracil; α-thio-uridine; 1 (aminoalkylamino-carbonylethylenyl)-2(thio)-pseudouracil; 1 (aminoalkylaminocarbonylethylenyl)-2,4-(dithio)pseudouracil; 1 (aminoalkylaminocarbonylethylenyl)-4 (thio)pseudouracil; 1 (aminoalkylaminocarbonylethylenyl)-pseudouracil; 1 (aminocarbonylethylenyl)-2(thio)-pseudouracil; 1 (aminocarbonylethylenyl)-2,4-(dithio)pseudouracil; 1 (aminocarbonylethylenyl)-4 (thio)pseudouracil; 1 (aminocarbonylethylenyl)-pseudouracil; 1 substituted 2(thio)-pseudouracil; 1 substituted 2,4-(dithio)pseudouracil; 1 substituted 4 (thio)pseudouracil; 1 substituted pseudouracil; 1-(aminoalkylamino-carbonylethylenyl)-2-(thio)-pseudouracil; 1-Methyl-3-(3-amino-3-carboxypropyl) pseudouridine TP; 1-Methyl-3-(3-amino-3-carboxypropyl)pseudo-UTP; 1-Methyl-pseudo-UTP; 2 (thio)pseudouracil; 2' deoxy uridine; 2' fluorouridine; 2-(thio)uracil; 2,4-(dithio)psuedouracil; 2' methyl, 2'amino, 2' azido, 2'fluro-guanosine; 2'-Amino-2'-deoxy-UTP; 2'-Azido-2'-deoxy-UTP; 2'-Azido-deoxyuridine TP; 2'-O-methylpseudouridine; 2' deoxy uridine; 2' fluorouridine; 2'-Deoxy-2'-a-aminouridine TP; 2'-Deoxy-2'-a-azidouridine TP; 2-methylpseudouridine; 3 (3 amino-3 carboxypropyl)uracil; 4 (thio)pseudouracil; 4-(thio) pseudouracil; 4-(thio)uracil; 4-thiouracil; 5 (1,3-diazole-1-alkyl)uracil; 5 (2-aminopropyl)uracil; 5 (aminoalkyl)uracil; 5 (dimethyl aminoalkyl)uracil; 5 (guanidiniumalkyl)uracil; 5 (methoxycarbonylmethyl)-2-(thio)uracil; 5 (methoxycarbonyl-methyl)uracil; 5 (methyl) 2 (thio)uracil; 5 (methyl) 2,4 (dithio)uracil; 5 (methyl) 4 (thio)uracil; 5 (methylaminomethyl)-2 (thio)uracil; 5 (methylaminomethyl)-2,4 (dithio)uracil; 5 (methylaminomethyl)-4 (thio) uracil; 5 (propynyl)uracil; 5 (trifluoromethyl)uracil; 5-(2-aminopropyl)uracil; 5-(alkyl)-2-(thio)pseudouracil; 5-(alkyl)-2,4 (dithio)pseudouracil; 5-(alkyl)-4 (thio) pseudouracil; 5-(alkyl)pseudouracil; 5-(alkyl)uracil; 5-(alkynyl)uracil; 5-(allylamino)uracil; 5-(cyanoalkyl)uracil; 5-(dialkylaminoalkyl)uracil; 5-(dimethylaminoalkyl) uracil; 5-(guanidiniumalkyl)uracil; 5-(halo)uracil; 5-(1,3-diazole-1-alkyl)uracil; 5-(methoxy)uracil; 5-(methoxycarbonylmethyl)-2-(thio)uracil; 5-(methoxycarbonyl-methyl)uracil; 5-(methyl) 2(thio)uracil; 5-(methyl) 2,4 (dithio)uracil; 5-(methyl) 4 (thio)uracil; 5-(methyl)-2-(thio)pseudouracil; 5-(methyl)-2,4 (dithio)pseudouracil; 5-(methyl)-4 (thio)pseudouracil; 5-(methyl)pseudouracil; 5-(methylaminomethyl)-2 (thio)uracil; 5-(methylaminomethyl)-2,4 (dithio)uracil; 5-(methylaminomethyl)-4-(thio)uracil; 5-(propynyl)uracil; 5-(trifluoromethyl)uracil; 5-amino allyl-uridine; 5-bromo-uridine; 5-iodo-uridine; 5-uracil; 6 (azo)uracil; 6-(azo)uracil; 6-aza-uridine; allyamino-uracil; aza uracil; deaza uracil; N3 (methyl)uracil; Pseudo-UTP-1-2-ethanoic acid; Pseudouracil; 4-Thio-pseudo-UTP; 1-carboxymethyl-pseudouridine; 1-methyl-1-de aza-pseudouridine; 1-propynyl-uridine; 1-taurinomethyl-1-methyl-uridine; 1-taurinomethyl-4-thio-uridine; 1-taurinomethyl-pseudouridine; 2-methoxy-4-thio-pseudouridine; 2-thio-1-methyl-1-deaza-pseudouridine; 2-thio-1-methyl-pseudouridine; 2-thio-5-aza-uridine; 2-thio-dihydropseudouridine; 2-thio-dihydrouridine; 2-thio-pseudouridine; 4-methoxy-2-thio-pseudouridine; 4-methoxy-pseudouridine; 4-thio-1-methyl-pseudouridine; 4-thio-pseudouridine; 5-aza-uridine; Dihydropseudouridine; (±)1-(2-Hydroxypropyl)pseudouridine TP; (2R)-1-(2-Hydroxypropyl)pseudouridine TP; (2S)-1-(2-Hydroxypropyl) pseudouridine TP; (E)-5-(2-Bromo-vinyl)ara-uridine TP; (E)-5-(2-Bromo-vinyl)uridine TP; (Z)-5-(2-Bromo-vinyl)ara-uridine TP; (Z)-5-(2-Bromo-vinyl)uridine TP; 1-(2,2,2-Trifluoroethyl)-pseudo-UTP; 1-(2,2,3,3,3-Pentafluoropropyl)pseudouridine TP; 1-(2,2-Diethoxyethyl)pseudouridine TP; 1-(2,4,6-Trimethylbenzyl)pseudouridine TP; 1-(2,4,6-Trimethyl-benzyl)pseudo-UTP; 1-(2,4,6-Trimethyl-phenyl)pseudo-UTP; 1-(2-Amino-2-carboxyethyl)pseudo-UTP; 1-(2-Amino-ethyl)pseudo-UTP; 1-(2-Hydroxyethyl) pseudouridine TP; 1-(2-Methoxyethyl)pseudouridine TP; 1-(3,4-Bis-trifluoromethoxybenzyl)pseudouridine TP; 1-(3,4-Dimethoxybenzyl)pseudouridine TP; 1-(3-Amino-3-carboxypropyl)pseudo-UTP; 1-(3-Amino-propyl)pseudo-UTP; 1-(3-Cyclopropyl-prop-2-ynyl)pseudouridine TP; 1-(4-Amino-4-carboxybutyl)pseudo-UTP; 1-(4-Amino-benzyl) pseudo-UTP; 1-(4-Amino-butyl)pseudo-UTP; 1-(4-Aminophenyl)pseudo-UTP; 1-(4-Azidobenzyl)pseudouridine TP; 1-(4-Bromobenzyl)pseudouridine TP; 1-(4-Chlorobenzyl) pseudouridine TP; 1-(4-Fluorobenzyl)pseudouridine TP; 1-(4-Iodobenzyl)pseudouridine TP; 1-(4-Methanesulfonylbenzyl)pseudouridine TP; 1-(4-Methoxybenzyl)pseudouridine TP; 1-(4-Methoxy-benzyl)pseudo-UTP; 1-(4-Methoxyphenyl)pseudo-UTP; 1-(4-Methylbenzyl)pseudouridine TP; 1-(4-Methyl-benzyl)pseudo-UTP; 1-(4-Nitrobenzyl) pseudouridine TP; 1-(4-Nitro-benzyl)pseudo-UTP; 1(4-Nitro-phenyl)pseudo-UTP; 1-(4-Thiomethoxybenzyl) pseudouridine TP; 1-(4-Trifluoromethoxybenzyl) pseudouridine TP; 1-(4-Trifluoromethylbenzyl) pseudouridine TP; 1-(5-Amino-pentyl)pseudo-UTP; 1-(6-Amino-hexyl)pseudo-UTP; 1,6-Dimethyl-pseudo-UTP; 1-[3-(2-{2-[2-(2-Aminoethoxy)-ethoxy]-ethoxy}-ethoxy)-propionyl]pseudouridine TP; 1-{3-[2-(2-Aminoethoxy)-ethoxy]-propionyl}pseudouridine TP; 1-Acetylpseudouridine TP; 1-Alkyl-6-(1-propynyl)-pseudo-UTP; 1-Alkyl-6-(2-propynyl)-pseudo-UTP; 1-Alkyl-6-allyl-pseudo-UTP; 1-Alkyl-6-ethynyl-pseudo-UTP; 1-Alkyl-6-homo allyl-pseudo-UTP; 1-Alkyl-6-vinyl-pseudo-UTP; 1-Allylpseudouridine TP; 1-Aminomethyl-pseudo-UTP; 1-Benzoylpseudouridine TP; 1-Benzyloxymethylpseudouridine TP; 1-Benzyl-pseudo-UTP; 1-Biotinyl-PEG2-pseudouridine TP; 1-Biotinylpseudouridine TP; 1-Butyl-pseudo-UTP; 1-Cyanomethylpseudouridine TP; 1-Cyclobutylmethyl-pseudo-UTP; 1-Cyclobutyl-pseudo-UTP; 1-Cycloheptylmethyl-pseudo-UTP; 1-Cycloheptyl-pseudo-UTP; 1-Cyclohexylmethyl-pseudo-UTP; 1-Cyclohexyl-pseudo-UTP; 1-Cyclooctylmethyl-pseudo-UTP; 1-Cyclooctyl-pseudo-UTP; 1-Cyclopentylmethyl-pseudo-UTP; 1-Cyclopentyl-pseudo-UTP; 1-Cyclopropylmethyl-pseudo-UTP; 1-Cyclopropyl-pseudo-UTP; 1-Ethyl-pseudo-UTP; 1-Hexyl-pseudo-UTP; 1-Homoallylpseudouridine TP; 1-Hydroxymethylpseudouridine TP; 1-iso-propyl-pseudo-UTP; 1-Me-2-thio-pseudo-UTP; 1-Me-4-thio-pseudo-UTP; 1-Me-alpha-thio-pseudo-UTP; 1-Methanesulfonylmethylpseudouridine TP; 1-Methoxymethylpseudouridine TP; 1-Methyl-6-(2,2,2-Trifluoroethyl)pseudo-UTP; 1-Methyl-6-(4-morpholino)-pseudo-UTP; 1-Methyl-6-(4-thiomorpholino)-pseudo-UTP; 1-Methyl-6-(substituted phenyl) pseudo-UTP; 1-Methyl-6-amino-pseudo-UTP; 1-Methyl-6- azido-pseudo-UTP; 1-Methyl-6-bromo-pseudo-UTP; 1-Methyl-6-butyl-pseudo-UTP; 1-Methyl-6-chloro-pseudo-UTP; 1-Methyl-6-cyano-pseudo-UTP; 1-Methyl-6-dimethylamino-pseudo-UTP; 1-Methyl-6-ethoxy-pseudo-UTP; 1-Methyl-6-ethylcarboxylate-pseudo-UTP; 1-Methyl-6-ethyl-pseudo-UTP; 1-Methyl-6-fluoro-pseudo-UTP; 1-Methyl-6-formyl-pseudo-UTP; 1-Methyl-6-hydroxyamino-pseudo-UTP; 1-Methyl-6-hydroxy-pseudo-UTP; 1-Methyl-6-iodo-pseudo-UTP; 1-Methyl-6-iso-propyl-pseudo-UTP; 1-Methyl-6-methoxy-pseudo-UTP; 1-Methyl-6-methylamino-pseudo-UTP; 1-Methyl-6-phenyl-pseudo-UTP; 1-Methyl-6-propyl-pseudo-UTP; 1-Methyl-6-tert-butyl-pseudo-UTP; 1-Methyl-6-trifluoromethoxy-pseudo-UTP; 1-Methyl-6-trifluoromethyl-pseudo-UTP; 1-Morpholinomethylpseudouridine TP; 1-Pentyl-pseudo-UTP; 1-Phenyl-pseudo-UTP; 1-Pivaloylpseudouridine TP; 1-Propargylpseudouridine TP; 1-Propyl-pseudo-UTP; 1-propynyl-pseudouridine; 1-p-tolyl-pseudo-UTP; 1-tert-Butyl-pseudo-UTP; 1-Thiomethoxymethylpseudouridine TP; 1-Thiomorpholinomethylpseudouridine TP; 1-Trifluoroacetylpseudouridine TP; 1-Trifluoromethyl-pseudo-UTP; 1-Vinylpseudouridine TP; 2,2'-anhydro-uridine TP; 2'-bromo-deoxyuridine TP; 2'-F-5-Methyl-2'-deoxy-TP; 2'-OMe-5-Me-UTP; 2'-OMe-pseudo-UTP; 2'-a-Ethynyluridine TP; 2'-a-Trifluoromethyluridine TP; 2'-b-Ethynyluridine TP; 2'-b-Trifluoromethyluridine TP; 2'-Deoxy-2',2'-difluorouridine TP; 2'-Deoxy-2'-a-mercaptouridine TP; 2'-Deoxy-2'-α-thiomethoxyuridine TP; 2'-Deoxy-2'-b-aminouridine TP; 2'-Deoxy-2'-b-azidouridine TP; 2'-Deoxy-2'-b-bromouridine TP; 2'-Deoxy-2'-b-chlorouridine TP; 2'-Deoxy-2'-b-fluorouridine TP; 2'-Deoxy-2'-b-iodouridine TP; 2'-Deoxy-2'-b-mercaptouridine TP; 2'-Deoxy-2'-b-thiomethoxyuridine TP; 2-methoxy-4-thio-uridine; 2-methoxyuridine; 2'-O-Methyl-5-(1-propynyl)uridine TP; 3-Alkyl-pseudo-UTP; 4'-Azidouridine TP; 4'-Carbocyclic uridine TP; 4'-Ethynyluridine TP; 5-(1-Propynyl)ara-uridine TP; 5-(2-Furanyl)uridine TP; 5-Cyanouridine TP; 5-Dimethylaminouridine TP; 5'-Homo-uridine TP; 5-iodo-2'-fluoro-deoxyuridine TP; 5-Phenylethynyluridine TP; 5-Trideuteromethyl-6-deuterouridine TP; 5-Trifluoromethyl-Uridine TP; 5-Vinylarauridine TP; 6-(2,2,2-Trifluoroethyl)-pseudo-UTP; 6-(4-Morpholino)-pseudo-UTP; 6-(4-Thiomorpholino)-pseudo-UTP; 6-(Substituted-Phenyl)-pseudo-UTP; 6-Amino-pseudo-UTP; 6-Azido-pseudo-UTP; 6-Bromo-pseudo-UTP; 6-Butyl-pseudo-UTP; 6-Chloro-pseudo-UTP; 6-Cyano-pseudo-UTP; 6-Dimethylamino-pseudo-UTP; 6-Ethoxy-pseudo-UTP; 6-Ethylcarboxylate-pseudo-UTP; 6-Ethyl-pseudo-UTP; 6-Fluoro-pseudo-UTP; 6-Formyl-pseudo-UTP; 6-Hydroxyamino-pseudo-UTP; 6-Hydroxy-pseudo-UTP; 6-Iodo-pseudo-UTP; 6-iso-Propyl-pseudo-UTP; 6-Methoxy-pseudo-UTP; 6-Methylamino-pseudo-UTP; 6-Methyl-pseudo-UTP; 6-Phenylpseudo-UTP; 6-Phenyl-pseudo-UTP; 6-Propyl-pseudo-UTP; 6-tert-Butyl-pseudo-UTP; 6-Trifluoromethoxy-pseudo-UTP; 6-Trifluoromethyl-pseudo-UTP; Alpha-thio-pseudo-UTP; Pseudouridine 1-(4-methylbenzenesulfonic acid) TP; Pseudouridine 1-(4-methylbenzoic acid) TP; Pseudouridine TP 1-[3-(2-ethoxy)]propionic acid; Pseudouridine TP 1-[3-{2-(2-[2-(2-ethoxy)-ethoxy]-ethoxy)-ethoxy}]propionic acid; Pseudouridine TP 1-[3-{2-(2-[2-{2(2-ethoxy)-ethoxy}-ethoxy]-ethoxy)-ethoxy}]propionic acid; Pseudouridine TP 1]-[3-o2-(2-[2-ethoxy]-ethoxy)-ethoxy}]propionic acid; Pseudouridine TP 1]-[3-{2-(2-ethoxy)-ethoxy}]propionic acid; Pseudouridine TP 1-methylphosphonic acid; Pseudouridine TP 1-methylphosphonic acid diethyl ester; Pseudo-UTP-N1-3-propionic acid; Pseudo-UTP-N1-4-butanoic acid; Pseudo-UTP-N1-5-pentanoic acid; Pseudo-UTP-N1-6-hexanoic acid; Pseudo-UTP-N1-7-heptanoic acid; Pseudo-UTP-N1-methyl-p-benzoic acid; Pseudo-UTP-N1-p-benzoic acid; Wybutosine; Hydroxywybutosine; Isowyosine; Peroxywybutosine; undermodified hydroxywybutosine; 4-demethylwyosine; 2,6-(diamino)purine; 1-(aza)-2-(thio)-3-(aza)-phenoxazin-1-yl: 1,3-(diaza)-2-(oxo)-phenthiazin-1-yl; 1,3-(diaza)-2-(oxo)-phenoxazin-1-yl; 1,3,5-(triaza)-2,6-(dioxa)-naphthalene; 2 (amino)purine; 2,4,5-(trimethyl)phenyl; 2' methyl, 2'amino, 2'azido, 2'fluro-cytidine; 2' methyl, 2'amino, 2'azido, 2'fluro-adenine; 2'methyl, 2'amino, 2'azido, 2'fluro-uridine; 2'-amino-2'-deoxyribose; 2-amino-6-Chloro-purine; 2-aza-inosinyl; 2'-azido-2'-deoxyribose; 2'fluoro-2'-deoxyribose; 2'-fluoro-modified bases; 2'-O-methyl-ribose; 2-oxo-7-aminopyridopyrimidin-3-yl; 2-oxo-pyridopyrimidine-3-yl; 2-pyridinone; 3 nitropyrrole; 3-(methyl)-7-(propynyl) isocarbostyrilyl; 3-(methyl)isocarbostyrilyl; 4-(fluoro)-6-(methyl)benzimidazole; 4-(methyl)benzimidazole; 4-(methyl)indolyl; 4,6-(dimethyl)indolyl; 5 nitroindole; 5 substituted pyrimidines; 5-(methyl)isocarbostyrilyl; 5-nitroindole; 6-(aza)pyrimidine; 6-(azo)thymine; 6-(methyl)-7-(aza)indolyl; 6-chloro-purine; 6-phenyl-pyrrolo-pyrimidin-2-on-3-yl; 7-(aminoalkylhydroxy)-1-(aza)-2-(thio)-3-(aza)-phenthiazin-1-yl; 7-(aminoalkylhydroxy)-1-(aza)-2-(thio)-3-(aza)-phenoxazin-1-yl; 7-(aminoalkylhydroxy)-1,3-(diaza)-2-(oxo)-phenoxazin-1-yl; 7-(aminoalkylhydroxy)-1,3-(diaza)-2-(oxo)-phenthiazin-1-yl; 7-(aminoalkylhydroxy)-1,3-(diaza)-2-(oxo)-phenoxazin-1-yl; 7-(aza)indolyl; 7-(guanidiniumalkylhydroxy)-1-(aza)-2-(thio)-3-(aza)-phenoxazinl-yl; 7-(guanidiniumalkylhydroxy)-1-(aza)-2-(thio)-3-(aza)-phenthiazin-1-yl; 7-(guanidiniumalkylhydroxy)-1-(aza)-2-(thio)-3-(aza)-phenoxazin-1-yl; 7-(guanidiniumalkylhydroxy)-1,3-(diaza)-2-(oxo)-phenoxazin-1-yl; 7-(guanidiniumalkyl-hydroxy)-1,3-(diaza)-2-(oxo)-phenthiazin-1-yl; 7-(guanidiniumalkylhydroxy)-1,3-(diaza)-2-(oxo)-phenoxazin-1-yl; 7-(propynyl)isocarbostyrilyl; 7-(propynyl)isocarbostyrilyl, propynyl-7-(aza)indolyl; 7-deaza-inosinyl; 7-substituted 1-(aza)-2-(thio)-3-(aza)-phenoxazin-1-yl; 7-substituted 1,3-(diaza)-2-(oxo)-phenoxazin-1-yl; 9-(methyl)-imidizopyridinyl; Aminoindolyl; Anthracenyl; bis-ortho-(aminoalkylhydroxy)-6-phenyl-pyrrolo-pyrimidin-2-on-3-yl; bis-ortho-substituted-6-phenyl-pyrrolo-pyrimidin-2-on-3-yl; Difluorotolyl; Hypoxanthine; Imidizopyridinyl; Inosinyl; Isocarbostyrilyl; Isoguanisine; N2-substituted purines; N6-methyl-2-amino-purine; N6-substituted purines; N-alkylated derivative; Napthalenyl; Nitrobenzimidazolyl; Nitroimidazolyl; Nitroindazolyl; Nitropyrazolyl; Nubularine; O6-substituted purines; O-alkylated derivative; ortho-(aminoalkylhydroxy)-6-phenyl-pyrrolo-pyrimidin-2-on-3-yl; ortho-substituted-6-phenyl-pyrrolo-pyrimidin-2-on-3-yl; Oxoformycin TP; para-(aminoalkylhydroxy)-6-phenyl-pyrrolo-pyrimidin-2-on-3-yl; para-substituted-6-phenyl-pyrrolo-pyrimidin-2-on-3-yl; Pentacenyl; Phenanthracenyl; Phenyl; propynyl-7-(aza)indolyl; Pyrenyl; pyridopyrimidin-3-yl; pyridopyrimidin-3-yl, 2-oxo-7-amino-pyridopyrimidin-3-yl; pyrrolo-pyrimidin-2-on-3-yl; Pyrrolopyrimidinyl; Pyrrolopyrizinyl; Stilbenzyl; substituted 1,2,4-triazoles; Tetracenyl; Tubercidine; Xanthine; Xanthosine-5'-TP; 2-thio-zebularine; 5-aza-2-thio-zebularine; 7-deaza-2-amino-purine; pyridin-4-one ribonucleoside; 2-Amino-riboside-TP; Formycin A TP; Formycin B TP; Pyrrolosine TP; 2'-OH-ara-adenosine TP; 2'-OH-ara-cytidine TP; 2'-OH-ara-uridine TP; 2'-OH-ara-guanosine TP; 5-(2-carbomethoxyvinyl)uridine TP; and N6-(19-Amino-pentaoxanonadecyl)adenosine TP.

In some embodiments, the polynucleotide (e.g., RNA polynucleotide, such as mRNA polynucleotide) includes a combination of at least two (e.g., 2, 3, 4 or more) of the aforementioned modified nucleobases.

In some embodiments, the mRNA comprises at least one chemically modified nucleoside. In some embodiments, the at least one chemically modified nucleoside is selected from the group consisting of pseudouridine (ψ), N1-methylpseudouridine (m1ψ), 2-thiouridine (s2U), 4'-thiouridine, 5-methylcytosine, 2-thio-1-methyl-1-deaza-pseudouridine, 2-thio-1-methyl-pseudouridine, 2-thio-5-aza-uridine, 2-thio-dihydropseudouridine, 2-thio-dihydrouridine, 2-thio-pseudouridine, 4-methoxy-2-thio-pseudouridine, 4-methoxy-pseudouridine, 4-thio-1-methyl-pseudouridine, 4-thio-pseudouridine, 5-aza-uridine, dihydropseudouridine, 5-methyluridine, 5-methoxyuridine, 2'-O-methyl uridine, 1-methyl-pseudouridine (m1ψ), 5-methoxy-uridine (mo5U), 5-methyl-cytidine (m5C), α-thio-guanosine, α-thio-adenosine, 5-cyano uridine, 4'-thio uridine 7-deaza-adenine, 1-methyl-adenosine (m1A), 2-methyl-adenine (m2A), N6-methyl-adenosine (m6A), and 2,6-Diaminopurine, (I), 1-methyl-inosine (m1I), wyosine (imG), methylwyosine (mimG), 7-deaza-guanosine, 7-cyano-7-deaza-guanosine (preQ0), 7-aminomethyl-7-deaza-guanosine (preQ1), 7-methyl-guanosine (m7G), 1-methyl-guanosine (m1G), 8-oxo-guanosine, 7-methyl-8-oxo-guanosine, 2,8-dimethyladenosine, 2-geranylthiouridine, 2-lysidine, 2-selenouridine, 3-(3-amino-3-carboxypropyl)-5,6-dihydrouridine, 3-(3-amino-3-carboxypropyl)pseudouridine, 3-methylpseudouridine, 5-(carboxyhydroxymethyl)-2'-O-methyluridine methyl ester, 5-aminomethyl-2-geranylthiouridine, 5-aminomethyl-2-selenouridine, 5-aminomethyluridine, 5-carbamoylhydroxymethyluridine, 5-carbamoylmethyl-2-thiouridine, 5-carboxymethyl-2-thiouridine, 5-carboxymethylaminomethyl-2-geranylthiouridine, 5-carboxymethyl-aminomethyl-2-selenouridine, 5-cyanomethyluridine, 5-hydroxycytidine, 5-methylaminomethyl-2-geranylthiouridine, 7-aminocarboxypropyl-demethylwyosine, 7-aminocarboxypropylwyosine, 7-aminocarboxypropylwyosine methyl ester, 8-methyladenosine, N4,N4-dimethylcytidine, N6-formyladenosine, N6-hydroxymethyladenosine, agmatidine, cyclic N6-threonylcarbamoyladenosine, glutamyl-queuosine, methylated undermodified hydroxywybutosine, N4,N4,2'-O-trimethylcytidine, geranylated 5-methylaminomethyl-2-thiouridine, geranylated 5-carboxymethylaminomethyl-2-thiouridine, Qbase, preQ0base, preQ1base, and two or more combinations thereof. In some embodiments, the at least one chemically modified nucleoside is selected from the group consisting of pseudouridine, N1-methylpseudouridine, 5-methylcytosine, 5-methoxyuridine, and a combination thereof. In some embodiments, the polynucleotide (e.g., RNA polynucleotide, such as mRNA polynucleotide) includes a combination of at least two (e.g., 2, 3, 4 or more) of the aforementioned modified nucleobases.

(i) Base Modifications

In certain embodiments, the chemical modification is at nucleobases in the polynucleotides (e.g., RNA polynucleotide, such as mRNA polynucleotide).

In some embodiments, a polynucleotide as disclosed herein comprises at least one chemically modified nucleobase.

In some embodiments, the at least one chemically modified nucleobase is selected from the group consisting of pseudouracil (ψ), N1-methylpseudouracil (m1ψ), 2-thiouracil (s2U), 4'-thiouracil, 5-methylcytosine, 2-thio-1-methyl-1-deaza-pseudouracil, 2-thio-1-methyl-pseudouracil, 2-thio-5-aza-uracil, 2-thio-dihydropseudouracil, 2-thio-dihydrouracil, 2-thio-pseudouracil, 4-methoxy-2-thio-pseudouracil, 4-methoxy-pseudouracil, 4-thio-1-methyl-pseudouracil, 4-thio-pseudouracil, 5-aza-uracil, dihydropseudouracil, 5-methyluracil, 5-methoxyuracil, 2'-O-methyl uracil, 1-methyl-pseudouracil (m1ψ), 5-methoxy-uracil (mo5U), 5-methyl-cytosine (m5C), α-thio-guanine, α-thio-adenine, 5-cyano uracil, 4'-thio uracil, 7-deaza-adenine, 1-methyl-adenine (m1A), 2-methyl-adenine (m2A), N6-methyl-adenine (m6A), and 2,6-Diaminopurine, (I), 1-methyl-inosine (m1I), wyosine (imG), methylwyosine (mimG), 7-deaza-guanine, 7-cyano-7-deaza-guanine (preQ0), 7-aminomethyl-7-deaza-guanine (preQ1), 7-methyl-guanine (m7G), 1-methyl-guanine (m1G), 8-oxo-guanine, 7-methyl-8-oxo-guanine, and two or more combinations thereof.

In some embodiments, the nucleobases in a polynucleotide as disclosed herein are chemically modified by at least about 10%, at least about 20%, at least about 30%, at least about 40%, at least about 50%, at least about 60%, at least about 70%, at least about 80%, at least about 90%, at least 95%, at least 99%, or 100%.

In some embodiments, the chemically modified nucleobases are selected from the group consisting of uracil, adenine, cytosine, guanine, and any combination thereof.

In some embodiments, the uracils in a polynucleotide disclosed herein are chemically modified by at least about 10%, at least about 20%, at least about 30%, at least about 40%, at least about 50%, at least about 60%, at least about 70%, at least about 80%, at least about 90%, at least 95%, at least 99%, or 100%.

In some embodiments, the adenines in a polynucleotide disclosed herein are chemically modified by at least about 10%, at least about 20%, at least about 30%, at least about 40%, at least about 50%, at least about 60%, at least about 70%, at least about 80%, at least about 90%, at least 95%, at least 99%, or 100%.

In some embodiments, the cytosines in a polynucleotide disclosed herein are chemically modified by at least about 10%, at least about 20%, at least about 30%, at least about 40%, at least about 50%, at least about 60%, at least about 70%, at least about 80%, at least about 90%, at least 95%, at least 99%, or 100%.

In some embodiments, the guanines in a polynucleotide disclosed herein are chemically modified by at least about 10%, at least about 20%, at least about 30%, at least about 40%, at least about 50%, at least about 60%, at least about 70%, at least about 80%, at least about 90%, at least 95%, at least 99%, or 100%.

In some embodiments, the polynucleotide (e.g., RNA polynucleotide, such as mRNA polynucleotide) includes a combination of at least two (e.g., 2, 3, 4 or more) of modified nucleobases. In some embodiments, modified nucleobases in the polynucleotide (e.g., RNA polynucleotide, such as mRNA polynucleotide) are selected from the group consisting of 1-methyl-pseudouridine (m1ψ), 5-methoxy-uridine (mo5U), 5-methyl-cytidine (m5C), pseudouridine (ψ), α-thio-guanosine and α-thio-adenosine. In some embodiments, the polynucleotide includes a combination of at least two (e.g., 2, 3, 4 or more) of the aforementioned modified nucleobases.

In some embodiments, the polynucleotide (e.g., RNA polynucleotide, such as mRNA polynucleotide) comprises pseudouridine (ψ) and 5-methyl-cytidine (m5C). In some embodiments, the polynucleotide (e.g., RNA polynucleotide, such as mRNA polynucleotide) comprises 1-methyl-pseudouridine (m1ψ). In some embodiments, the polynucleotide (e.g., RNA polynucleotide, such as mRNA polynucleotide) comprises 1-methyl-pseudouridine (m1ψ)

and 5-methyl-cytidine (m5C). In some embodiments, the polynucleotide (e.g., RNA polynucleotide, such as mRNA polynucleotide) comprises 2-thiouridine (s2U). In some embodiments, the polynucleotide (e.g., RNA polynucleotide, such as mRNA polynucleotide) comprises 2-thiouridine and 5-methyl-cytidine (m5C). In some embodiments, the polynucleotide (e.g., RNA polynucleotide, such as mRNA polynucleotide) comprises methoxy-uridine (mo5U). In some embodiments, the polynucleotide (e.g., RNA polynucleotide, such as mRNA polynucleotide) comprises 5-methoxy-uridine (mo5U) and 5-methyl-cytidine (m5C). In some embodiments, the polynucleotide (e.g., RNA polynucleotide, such as mRNA polynucleotide) comprises 2'-O-methyl uridine. In some embodiments, the polynucleotide (e.g., RNA polynucleotide, such as mRNA polynucleotide) comprises 2'-O-methyl uridine and 5-methyl-cytidine (m5C). In some embodiments, the polynucleotide (e.g., RNA polynucleotide, such as mRNA polynucleotide) comprises N6-methyl-adenosine (m6A). In some embodiments, the polynucleotide (e.g., RNA polynucleotide, such as mRNA polynucleotide) comprises N6-methyl-adenosine (m6A) and 5-methyl-cytidine (m5C).

In some embodiments, the polynucleotide (e.g., RNA polynucleotide, such as mRNA polynucleotide) is uniformly modified (e.g., fully modified, modified throughout the entire sequence) for a particular modification. For example, a polynucleotide can be uniformly modified with 5-methyl-cytidine (m5C), meaning that all cytosine residues in the mRNA sequence are replaced with 5-methyl-cytidine (m5C). Similarly, a polynucleotide can be uniformly modified for any type of nucleoside residue present in the sequence by replacement with a modified residue such as any of those set forth above.

In some embodiments, the modified nucleobase is a modified cytosine. Examples of nucleobases and nucleosides having a modified cytosine include N4-acetyl-cytidine (ac4C), 5-methyl-cytidine (m5C), 5-halo-cytidine (e.g., 5-iodo-cytidine), 5-hydroxymethyl-cytidine (hm5C), 1-methyl-pseudoisocytidine, 2-thio-cytidine (s2C), and 2-thio-5-methyl-cytidine.

In some embodiments, a modified nucleobase is a modified uridine. Example nucleobases and nucleosides having a modified uridine include 5-cyano uridine or 4'-thio uridine.

In some embodiments, a modified nucleobase is a modified adenine. Example nucleobases and nucleosides having a modified adenine include 7-deaza-adenine, 1-methyl-adenosine (m1A), 2-methyl-adenine (m2A), N6-methyl-adenine (m6A), and 2,6-Diaminopurine.

In some embodiments, a modified nucleobase is a modified guanine. Example nucleobases and nucleosides having a modified guanine include inosine (I), 1-methyl-inosine (m1I), wyosine (imG), methylwyosine (mimG), 7-deaza-guanosine, 7-cyano-7-deaza-guanosine (preQ0), 7-aminomethyl-7-deaza-guanosine (preQ1), 7-methyl-guanosine (m7G), 1-methyl-guanosine (m1G), 8-oxo-guanosine, 7-methyl-8-oxo-guanosine.

In some embodiments, the nucleobases, sugar, backbone, or any combination thereof in a polynucleotide, nucleic acid sequence, and/or ORF as disclosed herein are chemically modified by at least 10%, at least 20%, at least 30%, at least 40%, at least 50%, at least 60%, at least 70%, at least 80%, at least 90%, at least 95%, at least 99%, or 100%.

In some embodiments, the polynucleotides can include any useful linker between the nucleosides, including subunit linkers, membrane domain linkers, and heterologous polypeptide linkers as disclosed elsewhere herein. Such linkers, including backbone modifications, that are useful in the composition of the present disclosure include, but are not limited to the following: 3'-alkylene phosphonates, 3'-amino phosphoramidate, alkene containing backbones, aminoalkylphosphoramidates, aminoalkylphosphotriesters, boranophosphates, $-CH_2-O-N(CH_3)-CH_2-$, $-CH_2-N(CH_3)-N(CH_3)-CH_2-$, $-CH_2-NH-CH_2-$, chiral phosphonates, chiral phosphorothioates, formacetyl and thioformacetyl backbones, methylene (methylimino), methylene formacetyl and thioformacetyl backbones, methyleneimino and methylenehydrazino backbones, morpholino linkages, $-N(CH_3)-CH_2-CH_2-$, oligonucleosides with heteroatom internucleoside linkage, phosphinates, phosphoramidates, phosphorodithioates, phosphorothioate internucleoside linkages, phosphorothioates, phosphotriesters, PNA, siloxane backbones, sulfamate backbones, sulfide sulfoxide and sulfone backbones, sulfonate and sulfonamide backbones, thionoalkylphosphonates, thionoalkylphosphotriesters, and thionophosphoramidates.

(ii) Sugar Modifications

The modified nucleosides and nucleotides (e.g., building block molecules), which can be incorporated into a polynucleotide (e.g., RNA or mRNA, as described herein), can be modified on the sugar of the ribonucleic acid. For example, the 2' hydroxyl group (OH) can be modified or replaced with a number of different substituents. Exemplary substitutions at the 2'-position include, but are not limited to, H, halo, optionally substituted $C_{1-6}$ alkyl; optionally substituted $C_{1-6}$ alkoxy; optionally substituted $C_{6-10}$ aryloxy; optionally substituted $C_{3-8}$ cycloalkyl; optionally substituted $C_{3-8}$ cycloalkoxy; optionally substituted $C_{6-10}$ aryloxy; optionally substituted $C_{6-10}$ aryl-$C_{1-6}$ alkoxy, optionally substituted $C_{1-12}$ (heterocyclyl)oxy; a sugar (e.g., ribose, pentose, or any described herein); a polyethyleneglycol (PEG), $-O(CH_2CH_2O)_nCH_2CH_2OR$, where R is H or optionally substituted alkyl, and n is an integer from 0 to 20 (e.g., from 0 to 4, from 0 to 8, from 0 to 10, from 0 to 16, from 1 to 4, from 1 to 8, from 1 to 10, from 1 to 16, from 1 to 20, from 2 to 4, from 2 to 8, from 2 to 10, from 2 to 16, from 2 to 20, from 4 to 8, from 4 to 10, from 4 to 16, and from 4 to 20); "locked" nucleic acids (LNA) in which the 2'-hydroxyl is connected by a $C_{1-6}$ alkylene or $C_{1-6}$ heteroalkylene bridge to the 4'-carbon of the same ribose sugar, where exemplary bridges included methylene, propylene, ether, or amino bridges; aminoalkyl, as defined herein; aminoalkoxy, as defined herein; amino as defined herein; and amino acid, as defined herein Generally, RNA includes the sugar group ribose, which is a 5-membered ring having an oxygen. Exemplary, non-limiting modified nucleotides include replacement of the oxygen in ribose (e.g., with S, Se, or alkylene, such as methylene or ethylene); addition of a double bond (e.g., to replace ribose with cyclopentenyl or cyclohexenyl); ring contraction of ribose (e.g., to form a 4-membered ring of cyclobutane or oxetane); ring expansion of ribose (e.g., to form a 6- or 7-membered ring having an additional carbon or heteroatom, such as for anhydrohexitol, altritol, mannitol, cyclohexanyl, cyclohexenyl, and morpholino that also has a phosphoramidate backbone); multicyclic forms (e.g., tricyclo; and "unlocked" forms, such as glycol nucleic acid (GNA) (e.g., R-GNA or S-GNA, where ribose is replaced by glycol units attached to phosphodiester bonds), threose nucleic acid (TNA, where ribose is replace with α-L-threofuranosyl-(3'→2')), and peptide nucleic acid (PNA, where 2-amino-ethyl-glycine linkages replace the ribose and phosphodiester backbone). The sugar group can also contain one or more carbons that possess the opposite stereochemical configuration than that of the corresponding carbon in ribose. Thus, a polynucleotide molecule can include nucleotides containing, e.g., arabinose, as the sugar. Such sugar modifications are taught International Patent Publication Nos. WO2013052523 and WO2014093924, the contents of each of which are incorporated herein by reference in their entireties.

(iii) Combinations of Modifications

The polynucleotides of the disclosure (e.g., a polynucleotide comprising a nucleotide sequence encoding a tethered IL-12 polypeptide) can include a combination of modifications to the sugar, the nucleobase, and/or the internucleoside linkage. These combinations can include any one or more modifications described herein.

Combinations of modified nucleotides can be used to form the polynucleotides of the disclosure. Unless otherwise noted, the modified nucleotides can be completely substituted for the natural nucleotides of the polynucleotides of the disclosure. As a non-limiting example, the natural nucleotide uridine can be substituted with a modified nucleoside described herein. In another non-limiting example, the natural nucleotide uridine can be partially substituted or replaced (e.g., about 0.1%, 1%, 5%, 10%, 15%, 20%, 25%, 30%, 35%, 40%, 45%, 50%, 55%, 60%, 65%, 70%, 75%, 80%, 85%, 90%, 95% or 99.9%) with at least one of the modified nucleoside disclosed herein. Any combination of base/sugar or linker can be incorporated into the polynucleotides of the disclosure and such modifications are taught in International Patent Publications WO2013052523 and WO2014093924, and U.S. Publ. Nos. US 20130115272 and US20150307542, the contents of each of which are incorporated herein by reference in its entirety.

13. Untranslated Regions (UTRs)

Untranslated regions (UTRs) are nucleic acid sections of a polynucleotide before a start codon (5'UTR) and after a stop codon (3'UTR) that are not translated. In some embodiments, a polynucleotide (e.g., a ribonucleic acid (RNA), e.g., a messenger RNA (mRNA)) of the disclosure further comprises UTR (e.g., a 5'UTR or functional fragment thereof, a 3'UTR or functional fragment thereof, or a combination thereof).

A UTR can be homologous or heterologous to the coding region in a polynucleotide. In some embodiments, the UTR is homologous to the nucleic acid sequence encoding the IL-12 polypeptide. In some embodiments, the UTR is heterologous to the nucleic acid sequence encoding the IL-12 polypeptide. In some embodiments, the polynucleotide comprises two or more 5'UTRs or functional fragments thereof, each of which have the same or different nucleotide sequences. In some embodiments, the polynucleotide comprises two or more 3'UTRs or functional fragments thereof, each of which have the same or different nucleotide sequences.

In some embodiments, the 5'UTR or functional fragment thereof, 3' UTR or functional fragment thereof, or any combination thereof is sequence optimized.

In some embodiments, the 5'UTR or functional fragment thereof, 3' UTR or functional fragment thereof, or any combination thereof comprises at least one chemically modified nucleobase, e.g., 1 methylpseudouridine or 5-methoxyuracil.

UTRs can have features that provide a regulatory role, e.g., increased or decreased stability, localization and/or translation efficiency. A polynucleotide comprising a UTR can be administered to a cell, tissue, or organism, and one or more regulatory features can be measured using routine methods. In some embodiments, a functional fragment of a 5'UTR or 3'UTR comprises one or more regulatory features of a full length 5' or 3' UTR, respectively.

Natural 5'UTRs bear features that play roles in translation initiation. They harbor signatures like Kozak sequences that are commonly known to be involved in the process by which the ribosome initiates translation of many genes. Kozak sequences have the consensus CCR(A/G)CCAUGG (SEQ ID NO: 216), where R is a purine (adenine or guanine) three bases upstream of the start codon (AUG), which is followed by another 'G'. 5'UTRs also have been known to form secondary structures that are involved in elongation factor binding.

By engineering the features typically found in abundantly expressed genes of specific target organs, one can enhance the stability and protein production of a polynucleotide. For example, introduction of 5'UTR of liver-expressed mRNA, such as albumin, serum amyloid A, Apolipoprotein A/B/E, transferrin, alpha fetoprotein, erythropoietin, or Factor VIII, can enhance expression of polynucleotides in hepatic cell lines or liver. Likewise, use of 5'UTR from other tissue-specific mRNA to improve expression in that tissue is possible for muscle (e.g., MyoD, Myosin, Myoglobin, Myogenin, Herculin), for endothelial cells (e.g., Tie-1, CD36), for myeloid cells (e.g., C/EBP, AML1, G-CSF, GM-CSF, CD11b, MSR, Fr-1, i-NOS), for leukocytes (e.g., CD45, CD18), for adipose tissue (e.g., CD36, GLUT4, ACRP30, adiponectin) and for lung epithelial cells (e.g., SP-A/B/C/D).

In some embodiments, UTRs are selected from a family of transcripts whose proteins share a common function, structure, feature or property. For example, an encoded polypeptide can belong to a family of proteins (i.e., that share at least one function, structure, feature, localization, origin, or expression pattern), which are expressed in a particular cell, tissue or at some time during development. The UTRs from any of the genes or mRNA can be swapped for any other UTR of the same or different family of proteins to create a new polynucleotide.

In some embodiments, the 5'UTR and the 3'UTR can be heterologous. In some embodiments, the 5'UTR can be derived from a different species than the 3'UTR. In some embodiments, the 3'UTR can be derived from a different species than the 5'UTR.

Co-owned International Patent Application No. PCT/US2014/021522 (Publ. No. WO/2014/164253, incorporated herein by reference in its entirety) provides a listing of exemplary UTRs that can be utilized in the polynucleotide of the present disclosure as flanking regions to an ORF.

Exemplary UTRs of the application include, but are not limited to, one or more 5'UTR and/or 3'UTR derived from the nucleic acid sequence of: a globin, such as an α- or β-globin (e.g., a *Xenopus*, mouse, rabbit, or human globin); a strong Kozak translational initiation signal; a CYBA (e.g., human cytochrome b-245 α polypeptide); an albumin (e.g., human albumin7); a HSD17B4 (hydroxysteroid (17-β) dehydrogenase); a virus (e.g., a tobacco etch virus (TEV), a Venezuelan equine encephalitis virus (VEEV), a Dengue virus, a cytomegalovirus (CMV) (e.g., CMV immediate early 1 (IE1)), a hepatitis virus (e.g., hepatitis B virus), a sindbis virus, or a PAV barley yellow dwarf virus); a heat shock protein (e.g., hsp70); a translation initiation factor (e.g., eIF4G); a glucose transporter (e.g., hGLUT1 (human glucose transporter 1)); an actin (e.g., human α or β actin); a GAPDH; a tubulin; a histone; a citric acid cycle enzyme; a topoisomerase (e.g., a 5'UTR of a TOP gene lacking the 5' TOP motif (the oligopyrimidine tract)); a ribosomal protein Large 32 (L32); a ribosomal protein (e.g., human or mouse ribosomal protein, such as, for example, rps9); an ATP synthase (e.g., ATP5A1 or the β subunit of mitochondrial H⁺-ATP synthase); a growth hormone e (e.g., bovine (bGH) or human (hGH)); an elongation factor (e.g., elongation factor 1 α1 (EEF1A1)); a manganese superoxide dismutase (MnSOD); a myocyte enhancer factor 2A (MEF2A); a β-F1-ATPase, a creatine kinase, a myoglobin, a granulocyte-colony stimulating factor (G-CSF); a collagen (e.g., collagen type I, alpha 2 (Col1A2), collagen type I, alpha 1 (Col1A1), collagen type VI, alpha 2 (Col6A2), collagen type VI, alpha 1 (Col6A1)); a ribophorin (e.g., ribophorin I (RPNI)); a low density lipoprotein receptor-related protein (e.g., LRP1); a cardiotrophin-like cytokine factor (e.g., Nnt1); calreticulin (Calr); a procollagen-lysine, 2-oxoglutarate 5-dioxygenase 1 (Plod1); and a nucleobindin (e.g., Nucb1).

In some embodiments, the 5'UTR is selected from the group consisting of a β-globin 5'UTR; a 5'UTR containing a strong Kozak translational initiation signal; a cytochrome b-245 α polypeptide (CYBA) 5'UTR; a hydroxysteroid (17-β) dehydrogenase (HSD17B4) 5'UTR; a Tobacco etch virus (TEV) 5'UTR; a Venezuelen equine encephalitis virus (TEEV) 5'UTR; a 5' proximal open reading frame of rubella virus (RV) RNA encoding nonstructural proteins; a Dengue virus (DEN) 5'UTR; a heat shock protein 70 (Hsp70) 5'UTR; a eIF4G 5'UTR; a GLUT1 5'UTR; functional fragments thereof and any combination thereof.

In some embodiments, the 3'UTR is selected from the group consisting of a β-globin 3'UTR; a CYBA 3'UTR; an albumin 3'UTR; a growth hormone (GH) 3'UTR; a VEEV 3'UTR; a hepatitis B virus (HBV) 3'UTR; α-globin 3'UTR; a DEN 3'UTR; a PAV barley yellow dwarf virus (BYDV-PAV) 3'UTR; an elongation factor 1 α1 (EEF1A1) 3'UTR; a manganese superoxide dismutase (MnSOD) 3'UTR; a β subunit of mitochondrial H(+)-ATP synthase (β-mRNA) 3'UTR; a GLUT1 3'UTR; a MEF2A 3'UTR; a β-F1-ATPase 3'UTR; functional fragments thereof and combinations thereof.

Wild-type UTRs derived from any gene or mRNA can be incorporated into the polynucleotides of the disclosure. In some embodiments, a UTR can be altered relative to a wild type or native UTR to produce a variant UTR, e.g., by changing the orientation or location of the UTR relative to the ORF; or by inclusion of additional nucleotides, deletion of nucleotides, swapping or transposition of nucleotides. In some embodiments, variants of 5' or 3' UTRs can be utilized, for example, mutants of wild type UTRs, or variants wherein one or more nucleotides are added to or removed from a terminus of the UTR.

Additionally, one or more synthetic UTRs can be used in combination with one or more non-synthetic UTRs. See, e.g., Mandal and Rossi, Nat. Protoc. 2013 8(3):568-82, the contents of which are incorporated herein by reference in their entirety, and sequences available at www.addgene.org/Derrick_Rossi/, last accessed Apr. 16, 2016. UTRs or portions thereof can be placed in the same orientation as in the transcript from which they were selected or can be altered in orientation or location. Hence, a 5' and/or 3' UTR can be inverted, shortened, lengthened, or combined with one or more other 5' UTRs or 3' UTRs.

In some embodiments, the polynucleotide comprises multiple UTRs, e.g., a double, a triple or a quadruple 5'UTR or 3'UTR. For example, a double UTR comprises two copies of the same UTR either in series or substantially in series. For example, a double beta-globin 3'UTR can be used (see US2010/0129877, the contents of which are incorporated herein by reference in its entirety). In certain embodiments, the polynucleotides of the disclosure comprise a 5'UTR and/or a 3'UTR selected from any of the UTRs disclosed herein.

In some embodiments, the 5'UTR comprises a sequence selected from the group consisting of: SEQ ID NOs: 55-63 and 82-97.

In some embodiments, the 3'UTR comprises a sequence selected from the group consisting of: SEQ ID NOs: 64-81.

In certain embodiments, the 5'UTR and/or 3'UTR sequence of the disclosure comprises a nucleotide sequence at least about 60%, at least about 70%, at least about 80%, at least about 90%, at least about 95%, at least about 96%, at least about 97%, at least about 98%, at least about 99%, or about 100% identical to a sequence selected from the group consisting of 5'UTR sequences comprising any of the 5'UTR sequences disclosed herein and/or 3'UTR sequences comprises any of the 3'UTR sequences disclosed herein, and any combination thereof.

In certain embodiments, the 3' UTR sequence comprises one or more miRNA binding sites, e.g., miR-122 binding sites, or any other heterologous nucleotide sequences therein, without disrupting the function of the 3' UTR. Some examples of 3' UTR sequences comprising a miRNA binding site are set forth in SEQ ID NOs: 222-224. In some embodiments, the 3' UTR sequence comprises a nucleotide sequence at least about 60%, at least about 70%, at least about 80%, at least about 90%, at least about 95%, at least about 96%, at least about 97%, at least about 98%, at least about 99%, or about 100% identical to a sequence selected from the group consisting of SEQ ID NOs: 222-224. In certain embodiments, the 3' UTR sequence comprises a nucleotide sequence at least about 60%, at least about 70%, at least about 80%, at least about 90%, at least about 95%, at least about 96%, at least about 97%, at least about 98%, at least about 99%, or about 100% identical to SEQ ID NO: 222. In certain embodiments, the 3' UTR sequence comprises a nucleotide sequence at least about 60%, at least about 70%, at least about 80%, at least about 90%, at least about 95%, at least about 96%, at least about 97%, at least about 98%, at least about 99%, or about 100% identical to SEQ ID NO: 223. In certain embodiments, the 3' UTR sequence comprises a nucleotide sequence at least about 60%, at least about 70%, at least about 80%, at least about 90%, at least about 95%, at least about 96%, at least about 97%, at least about 98%, at least about 99%, or about 100% identical to SEQ ID NO: 224.

The polynucleotides of the disclosure can comprise combinations of features. For example, the ORF can be flanked by a 5'UTR that comprises a strong Kozak translational initiation signal and/or a 3'UTR comprising an oligo(dT) sequence for templated addition of a poly-A tail. A 5'UTR can comprise a first polynucleotide fragment and a second polynucleotide fragment from the same and/or different UTRs (see, e.g., US2010/0293625, herein incorporated by reference in its entirety).

Other non-UTR sequences can be used as regions or subregions within the polynucleotides of the disclosure. For example, introns or portions of intron sequences can be incorporated into the polynucleotides of the disclosure. Incorporation of intronic sequences can increase protein production as well as polynucleotide expression levels. In some embodiments, the polynucleotide of the disclosure comprises an internal ribosome entry site (IRES) instead of or in addition to a UTR (see, e.g., Yakubov et al., Biochem. Biophys. Res. Commun. 2010 394(1):189-193, the contents of which are incorporated herein by reference in their entirety). In some embodiments, the polynucleotide comprises an IRES instead of a 5'UTR sequence. In some embodiments, the polynucleotide comprises an ORF and a viral capsid sequence. In some embodiments, the polynucleotide comprises a synthetic 5'UTR in combination with a non-synthetic 3'UTR.

In some embodiments, the UTR can also include at least one translation enhancer polynucleotide, translation enhancer element, or translational enhancer elements (collectively, "TEE," which refers to nucleic acid sequences that increase the amount of polypeptide or protein produced from a polynucleotide. As a non-limiting example, the TEE can include those described in US2009/0226470, incorporated herein by reference in its entirety, and others known in the art. As a non-limiting example, the TEE can be located between the transcription promoter and the start codon. In some embodiments, the 5'UTR comprises a TEE.

In one aspect, a TEE is a conserved element in a UTR that can promote translational activity of a nucleic acid such as, but not limited to, cap-dependent or cap-independent translation. In one non-limiting example, the TEE comprises the TEE sequence in the 5'-leader of the Gtx homeodomain protein. See Chappell et al., PNAS 2004 101:9590-9594, incorporated herein by reference in its entirety.

In some embodiments, the polynucleotide of the invention comprises one or multiple copies of a TEE. The TEE in a translational enhancer polynucleotide can be organized in one or more sequence segments. A sequence segment can harbor one or more of the TEEs provided herein, with each TEE being present in one or more copies. When multiple sequence segments are present in a translational enhancer polynucleotide, they can be homogenous or heterogeneous. Thus, the multiple sequence segments in a translational enhancer polynucleotide can harbor identical or different types of the TEE provided herein, identical or different number of copies of each of the TEE, and/or identical or different organization of the TEE within each sequence segment. In one embodiment, the polynucleotide of the invention comprises a translational enhancer polynucleotide sequence. Non-limiting examples of TEE sequences are described in U.S. Publication 2014/0200261, the contents of which are incorporated herein by reference in their entirety.

14. Functional RNA Elements

In some embodiments, the disclosure provides polynucleotides comprising a modification (e.g., an RNA element), wherein the modification provides a desired translational regulatory activity. In some embodiments, the disclosure provides a polynucleotide comprising a 5' untranslated region (UTR), an initiation codon, a full open reading frame encoding a polypeptide, a 3' UTR, and at least one modification, wherein the at least one modification provides a desired translational regulatory activity, for example, a modification that promotes and/or enhances the translational fidelity of mRNA translation. In some embodiments, the desired translational regulatory activity is a cis-acting regulatory activity. In some embodiments, the desired translational regulatory activity is an increase in the residence time of the 43S pre-initiation complex (PIC) or ribosome at, or proximal to, the initiation codon. In some embodiments, the desired translational regulatory activity is an increase in the initiation of polypeptide synthesis at or from the initiation codon. In some embodiments, the desired translational regulatory activity is an increase in the amount of polypeptide translated from the full open reading frame. In some embodiments, the desired translational regulatory activity is an increase in the fidelity of initiation codon decoding by the PIC or ribosome. In some embodiments, the desired translational regulatory activity is inhibition or reduction of leaky scanning by the PIC or ribosome. In some embodiments, the desired translational regulatory activity is a decrease in the rate of decoding the initiation codon by the PIC or ribosome. In some embodiments, the desired translational regulatory activity is inhibition or reduction in the initiation of polypeptide synthesis at any codon within the mRNA other than the initiation codon. In some embodiments, the desired translational regulatory activity is inhibition or reduction of the amount of polypeptide translated from any open reading frame within the mRNA other than the full open reading frame. In some embodiments, the desired translational regulatory activity is inhibition or reduction in the production of aberrant translation products. In some embodiments, the desired translational regulatory activity is a combination of one or more of the foregoing translational regulatory activities.

Accordingly, the present disclosure provides a polynucleotide, e.g., an mRNA, comprising an RNA element that comprises a sequence and/or an RNA secondary structure(s) that provides a desired translational regulatory activity as described herein. In some aspects, the mRNA comprises an RNA element that comprises a sequence and/or an RNA secondary structure(s) that promotes and/or enhances the translational fidelity of mRNA translation. In some aspects, the mRNA comprises an RNA element that comprises a sequence and/or an RNA secondary structure(s) that provides a desired translational regulatory activity, such as inhibiting and/or reducing leaky scanning. In some aspects, the disclosure provides an mRNA that comprises an RNA element that comprises a sequence and/or an RNA secondary structure(s) that inhibits and/or reduces leaky scanning thereby promoting the translational fidelity of the mRNA.

In some embodiments, the RNA element comprises natural and/or modified nucleotides. In some embodiments, the RNA element comprises of a sequence of linked nucleotides, or derivatives or analogs thereof, that provides a desired translational regulatory activity as described herein. In some embodiments, the RNA element comprises a sequence of linked nucleotides, or derivatives or analogs thereof, that forms or folds into a stable RNA secondary structure, wherein the RNA secondary structure provides a desired translational regulatory activity as described herein. RNA elements can be identified and/or characterized based on the primary sequence of the element (e.g., GC-rich element), by RNA secondary structure formed by the element (e.g. stem-loop), by the location of the element within the RNA molecule (e.g., located within the 5' UTR of an mRNA), by the biological function and/or activity of the element (e.g., "translational enhancer element"), and any combination thereof.

In some embodiments, the disclosure provides an mRNA having one or more structural modifications that inhibits leaky scanning and/or promotes the translational fidelity of mRNA translation, wherein at least one of the structural modifications is a GC-rich RNA element. In some embodiments, the disclosure provides an mRNA comprising at least one modification, wherein at least one modification is a GC-rich RNA element comprising a sequence of linked nucleotides, or derivatives or analogs thereof, preceding a Kozak consensus sequence in a 5' UTR of the mRNA. In one embodiment, the GC-rich RNA element is located about 30, about 25, about 20, about 15, about 10, about 5, about 4, about 3, about 2, or about 1 nucleotide(s) upstream of a Kozak consensus sequence in the 5' UTR of the mRNA. In another embodiment, the GC-rich RNA element is located 15-30, 15-20, 15-25, 10-15, or 5-10 nucleotides upstream of a Kozak consensus sequence. In another embodiment, the GC-rich RNA element is located immediately adjacent to a Kozak consensus sequence in the 5' UTR of the mRNA.

In some embodiments, the disclosure provides a GC-rich RNA element which comprises a sequence of 3-30, 5-25, 10-20, 15-20, about 20, about 15, about 12, about 10, about 7, about 6 or about 3 nucleotides, derivatives or analogs thereof, linked in any order, wherein the sequence composition is 70-80% cytosine, 60-70% cytosine, 50%-60% cytosine, 40-50% cytosine, 30-40% cytosine bases. In some embodiments, the disclosure provides a GC-rich RNA element which comprises a sequence of 3-30, 5-25, 10-20, 15-20, about 20, about 15, about 12, about 10, about 7, about 6 or about 3 nucleotides, derivatives or analogs thereof, linked in any order, wherein the sequence composition is about 80% cytosine, about 70% cytosine, about 60% cytosine, about 50% cytosine, about 40% cytosine, or about 30% cytosine.

In some embodiments, the disclosure provides a GC-rich RNA element which comprises a sequence of 20, 19, 18, 17, 16, 15, 14, 13, 12, 11, 10, 9, 8, 7, 6, 5, 4, or 3 nucleotides, or derivatives or analogs thereof, linked in any order, wherein the sequence composition is 70-80% cytosine, 60-70% cytosine, 50%-60% cytosine, 40-50% cytosine, or 30-40% cytosine. In some embodiments, the disclosure provides a GC-rich RNA element which comprises a sequence of 20, 19, 18, 17, 16, 15, 14, 13, 12, 11, 10, 9, 8, 7, 6, 5, 4, or 3 nucleotides, or derivatives or analogs thereof, linked in any order, wherein the sequence composition is about 80% cytosine, about 70% cytosine, about 60% cytosine, about 50% cytosine, about 40% cytosine, or about 30% cytosine.

In some embodiments, the disclosure provides an mRNA comprising at least one modification, wherein at least one modification is a GC-rich RNA element comprising a sequence of linked nucleotides, or derivatives or analogs thereof, preceding a Kozak consensus sequence in a 5' UTR of the mRNA, wherein the GC-rich RNA element is located about 30, about 25, about 20, about 15, about 10, about 5, about 4, about 3, about 2, or about 1 nucleotide(s) upstream of a Kozak consensus sequence in the 5' UTR of the mRNA, and wherein the GC-rich RNA element comprises a sequence of 3, 4, 5, 6, 7, 8, 9, 10, 11, 12, 13, 14, 15, 16, 17, 18, 19, or 20 nucleotides, or derivatives or analogs thereof, linked in any order, wherein the sequence composition is >50% cytosine. In some embodiments, the sequence composition is >55% cytosine, >60% cytosine, >65% cytosine, >70% cytosine, >75% cytosine, >80% cytosine, >85% cytosine, or >90% cytosine.

In some embodiments, the disclosure provides an mRNA comprising at least one modification, wherein at least one modification is a GC-rich RNA element comprising a sequence of linked nucleotides, or derivatives or analogs thereof, preceding a Kozak consensus sequence in a 5' UTR of the mRNA, wherein the GC-rich RNA element is located about 30, about 25, about 20, about 15, about 10, about 5, about 4, about 3, about 2, or about 1 nucleotide(s) upstream of a Kozak consensus sequence in the 5' UTR of the mRNA, and wherein the GC-rich RNA element comprises a sequence of about 3-30, 5-25, 10-20, 15-20 or about 20, about 15, about 12, about 10, about 6 or about 3 nucleotides, or derivatives or analogues thereof, wherein the sequence comprises a repeating GC-motif, wherein the repeating GC-motif is [CCG]n, wherein n=1 to 10, n=2 to 8, n=3 to 6, or n=4 to 5. In some embodiments, the sequence comprises a repeating GC-motif [CCG]n, wherein n=1, 2, 3, 4 or 5. In some embodiments, the sequence comprises a repeating GC-motif [CCG]n, wherein n=1, 2, or 3. In some embodiments, the sequence comprises a repeating GC-motif [CCG]n, wherein n=1. In some embodiments, the sequence comprises a repeating GC-motif [CCG]n, wherein n=2. In some embodiments, the sequence comprises a repeating GC-motif [CCG]n, wherein n=3. In some embodiments, the sequence comprises a repeating GC-motif [CCG]n, wherein n=4 (SEQ ID NO: 256). In some embodiments, the sequence comprises a repeating GC-motif [CCG]n, wherein n=5 (SEQ ID NO: 257).

In some embodiments, the GC-rich RNA element is located about 30, about 25, about 20, about 15, about 10, about 5, about 4, about 3, about 2, or about 1 nucleotide(s) upstream of a Kozak consensus sequence in the 5' UTR of the mRNA. In another embodiment, the GC-rich RNA element is located about 15-30, 15-20, 15-25, 10-15, or 5-10 nucleotides upstream of a Kozak consensus sequence. In another embodiment, the GC-rich RNA element is located immediately adjacent to a Kozak consensus sequence in the 5' UTR of the mRNA.

In some embodiments, the disclosure provides an mRNA comprising at least one modification, wherein at least one modification is a GC-rich RNA element comprising the sequence set forth in SEQ ID NO: 258, or derivatives or analogs thereof, preceding a Kozak consensus sequence in the 5' UTR of the mRNA. In some embodiments, the GC-rich element comprises the sequence as set forth in SEQ ID NO: 258 located immediately adjacent to and upstream of the Kozak consensus sequence in the 5' UTR of the mRNA. In some embodiments, the GC-rich element comprises the sequence as set forth in SEQ ID NO: 258 located 1, 2, 3, 4, 5, 6, 7, 8, 9 or 10 bases upstream of the Kozak consensus sequence in the 5' UTR of the mRNA. In other embodiments, the GC-rich element comprises the sequence as set forth in SEQ ID NO: 258 located 1-3, 3-5, 5-7, 7-9, 9-12, or 12-15 bases upstream of the Kozak consensus sequence in the 5' UTR of the mRNA.

In some embodiments, the disclosure provides an mRNA comprising at least one modification, wherein at least one modification is a GC-rich RNA element comprising the sequence as set forth SEQ ID NO: 259, or derivatives or analogs thereof, preceding a Kozak consensus sequence in the 5' UTR of the mRNA. In some embodiments, the GC-rich element comprises the sequence as set forth SEQ ID NO: 259 located immediately adjacent to and upstream of the Kozak consensus sequence in the 5' UTR of the mRNA. In some embodiments, the GC-rich element comprises the sequence as set forth SEQ ID NO: 259 located 1, 2, 3, 4, 5, 6, 7, 8, 9 or 10 bases upstream of the Kozak consensus sequence in the 5' UTR of the mRNA. In other embodiments, the GC-rich element comprises the sequence as set forth SEQ ID NO: 259 located 1-3, 3-5, 5-7, 7-9, 9-12, or 12-15 bases upstream of the Kozak consensus sequence in the 5' UTR of the mRNA.

In some embodiments, the disclosure provides an mRNA comprising at least one modification, wherein at least one modification is a GC-rich RNA element comprising the sequence as set forth in SEQ ID NO: 260, or derivatives or analogs thereof, preceding a Kozak consensus sequence in the 5' UTR of the mRNA. In some embodiments, the GC-rich element comprises the sequence as set forth in SEQ ID NO: 260 located immediately adjacent to and upstream of the Kozak consensus sequence in the 5' UTR of the mRNA. In some embodiments, the GC-rich element comprises the sequence as set forth in SEQ ID NO: 260 located 1, 2, 3, 4, 5, 6, 7, 8, 9 or 10 bases upstream of the Kozak consensus sequence in the 5' UTR of the mRNA. In other embodiments, the GC-rich element comprises the sequence as set forth in SEQ ID NO: 260 located 1-3, 3-5, 5-7, 7-9, 9-12, or 12-15 bases upstream of the Kozak consensus sequence in the 5' UTR of the mRNA.

In some embodiments, the disclosure provides an mRNA comprising at least one modification, wherein at least one modification is a GC-rich RNA element comprising the sequence set forth in SEQ ID NO: 258, or derivatives or analogs thereof, preceding a Kozak consensus sequence in the 5' UTR of the mRNA, wherein the 5' UTR comprises the sequence set forth in SEQ ID NO: 261.

In some embodiments, the GC-rich element comprises the sequence set forth in SEQ ID NO: 258 located immediately adjacent to and upstream of the Kozak consensus sequence in a 5' UTR sequence described herein. In some embodiments, the GC-rich element comprises the sequence set forth in SEQ ID NO: 258 located 1, 2, 3, 4, 5, 6, 7, 8, 9 or 10 bases upstream of the Kozak consensus sequence in the 5' UTR of the mRNA, wherein the 5' UTR comprises the sequence shown in SEQ ID NO: 261.

In other embodiments, the GC-rich element comprises the sequence set forth in SEQ ID NO: 258 located 1-3, 3-5, 5-7, 7-9, 9-12, or 12-15 bases upstream of the Kozak consensus sequence in the 5' UTR of the mRNA, wherein the 5' UTR comprises the sequence set forth in SEQ ID NO: 261.

In some embodiments, the 5' UTR comprises the sequence set forth in SEQ ID NO: 262.

In some embodiments, the 5' UTR comprises the sequence set forth in SEQ ID NO: 263.

In some embodiments, the disclosure provides an mRNA comprising at least one modification, wherein at least one modification is a GC-rich RNA element comprising a stable RNA secondary structure comprising a sequence of nucleotides, or derivatives or analogs thereof, linked in an order which forms a hairpin or a stem-loop. In one embodiment, the stable RNA secondary structure is upstream of the Kozak consensus sequence. In another embodiment, the stable RNA secondary structure is located about 30, about 25, about 20, about 15, about 10, or about 5 nucleotides upstream of the Kozak consensus sequence. In another embodiment, the stable RNA secondary structure is located about 20, about 15, about 10 or about 5 nucleotides upstream of the Kozak consensus sequence. In another embodiment, the stable RNA secondary structure is located about 5, about 4, about 3, about 2, about 1 nucleotides upstream of the Kozak consensus sequence. In another embodiment, the stable RNA secondary structure is located about 15-30, about 15-20, about 15-25, about 10-15, or about 5-10 nucleotides upstream of the Kozak consensus sequence. In another embodiment, the stable RNA secondary structure is located 12-15 nucleotides upstream of the Kozak consensus sequence. In another embodiment, the stable RNA secondary structure has a deltaG of about −30 kcal/mol, about −20 to −30 kcal/mol, about −20 kcal/mol, about −10 to −20 kcal/mol, about −10 kcal/mol, about −5 to −10 kcal/mol.

In another embodiment, the modification is operably linked to an open reading frame encoding a polypeptide and wherein the modification and the open reading frame are heterologous.

In another embodiment, the sequence of the GC-rich RNA element is comprised exclusively of guanine (G) and cytosine (C) nucleobases.

RNA elements that provide a desired translational regulatory activity as described herein can be identified and characterized using known techniques, such as ribosome profiling. Ribosome profiling is a technique that allows the determination of the positions of PICs and/or ribosomes bound to mRNAs (see e.g., Ingolia et al., (2009) Science 324(5924):218-23, incorporated herein by reference). The technique is based on protecting a region or segment of mRNA, by the PIC and/or ribosome, from nuclease digestion. Protection results in the generation of a 30-bp fragment of RNA termed a 'footprint'. The sequence and frequency of RNA footprints can be analyzed by methods known in the art (e.g., RNA-seq). The footprint is roughly centered on the A-site of the ribosome. If the PIC or ribosome dwells at a particular position or location along an mRNA, footprints generated at these position would be relatively common. Studies have shown that more footprints are generated at positions where the PIC and/or ribosome exhibits decreased processivity and fewer footprints where the PIC and/or ribosome exhibits increased processivity (Gardin et al., (2014) eLife 3:e03735). In some embodiments, residence time or the time of occupancy of a the PIC or ribosome at a discrete position or location along an polynucleotide comprising any one or more of the RNA elements described herein is determined by ribosome profiling.

15. MicroRNA (miRNA) Binding Sites

Sensor sequences include, for example, microRNA (miRNA) binding sites, transcription factor binding sites, structured mRNA sequences and/or motifs, artificial binding sites engineered to act as pseudo-receptors for endogenous nucleic acid binding molecules, and combinations thereof. Non-limiting examples of sensor sequences are described in U.S. Publication 2014/0200261, the contents of which are incorporated herein by reference in their entirety.

In some embodiments, a polynucleotide (e.g., a ribonucleic acid (RNA), e.g., a messenger RNA (mRNA)) of the disclosure further comprises a sensor sequence. In some embodiments, the sensor sequence is a miRNA binding site.

A miRNA is a 19-25 nucleotide long noncoding RNA that binds to a polynucleotide and down-regulates gene expression either by reducing stability or by inhibiting translation of the polynucleotide. A miRNA sequence comprises a "seed" region, i.e., a sequence in the region of positions 2-8 of the mature miRNA. A miRNA seed can comprise positions 2-8 or 2-7 of the mature miRNA. In some embodiments, a miRNA seed can comprise 7 nucleotides (e.g., nucleotides 2-8 of the mature miRNA), wherein the seed-complementary site in the corresponding miRNA binding site is flanked by an adenosine (A) opposed to miRNA position 1. In some embodiments, a miRNA seed can comprise 6 nucleotides (e.g., nucleotides 2-7 of the mature miRNA), wherein the seed-complementary site in the corresponding miRNA binding site is flanked by an adenosine (A) opposed to miRNA position 1. See, for example, Grimson A, Farh K K, Johnston W K, Garrett-Engele P, Lim L P, Bartel D P; Mol Cell. 2007 Jul. 6; 27(1):91-105. miRNA profiling of the target cells or tissues can be conducted to determine the presence or absence of miRNA in the cells or tissues. In some embodiments, a polynucleotide (e.g., a ribonucleic acid (RNA), e.g., a messenger RNA (mRNA)) of the disclosure comprises one or more microRNA target sequences, microRNA sequences, or microRNA seeds. Such sequences can correspond to any known microRNA such as those taught in US Publication US2005/0261218 and US Publication US2005/0059005, the contents of each of which are incorporated herein by reference in their entirety.

As used herein, the term "microRNA (miRNA or miR) binding site" refers to a sequence within a polynucleotide, e.g., within a DNA or within an RNA transcript, including in the 5'UTR and/or 3'UTR, that has sufficient complementarity to all or a region of a miRNA to interact with, associate with or bind to the miRNA. In some embodiments, a polynucleotide of the disclosure further comprises a miRNA binding site. In exemplary embodiments, a 5'UTR and/or 3'UTR of the polynucleotide (e.g., a ribonucleic acid (RNA), e.g., a messenger RNA (mRNA)) comprises a miRNA binding site.

A miRNA binding site having sufficient complementarity to a miRNA refers to a degree of complementarity sufficient to facilitate miRNA-mediated regulation of a polynucleotide, e.g., miRNA-mediated translational repression or degradation of the polynucleotide. In exemplary aspects of the disclosure, a miRNA binding site having sufficient complementarity to the miRNA refers to a degree of complementarity sufficient to facilitate miRNA-mediated degradation of the polynucleotide, e.g., miRNA-guided RNA-induced silencing complex (RISC)-mediated cleavage of mRNA. The miRNA binding site can have complementarity to, for example, a 19-25 nucleotide miRNA sequence, to a 19-23 nucleotide miRNA sequence, or to a 22 nucleotide miRNA sequence. A miRNA binding site can be complementary to only a portion of a miRNA, e.g., to a portion less than 1, 2, 3, or 4 nucleotides of the full length of a naturally-occurring miRNA sequence. Full or complete complementarity (e.g., full complementarity or complete complementarity over all or a significant portion of the length of a naturally-occurring miRNA) is preferred when the desired regulation is mRNA degradation.

In some embodiments, a miRNA binding site includes a sequence that has complementarity (e.g., partial or complete complementarity) with a miRNA seed sequence. In some embodiments, the miRNA binding site includes a sequence that has complete complementarity with a miRNA seed sequence. In some embodiments, a miRNA binding site includes a sequence that has complementarity (e.g., partial or complete complementarity) with a miRNA sequence. In some embodiments, the miRNA binding site includes a sequence that has complete complementarity with a miRNA sequence. In some embodiments, a miRNA binding site has complete complementarity with a miRNA sequence but for 1, 2, or 3 nucleotide substitutions, terminal additions, and/or truncations.

In some embodiments, the miRNA binding site is the same length as the corresponding miRNA. In other embodiments, the miRNA binding site is one, two, three, four, five, six, seven, eight, nine, ten, eleven or twelve nucleotide(s) shorter than the corresponding miRNA at the 5' terminus, the 3' terminus, or both. In still other embodiments, the microRNA binding site is two nucleotides shorter than the corresponding microRNA at the 5' terminus, the 3' terminus, or both. The miRNA binding sites that are shorter than the corresponding miRNAs are still capable of degrading the mRNA incorporating one or more of the miRNA binding sites or preventing the mRNA from translation.

In some embodiments, the miRNA binding site binds to the corresponding mature miRNA that is part of an active RISC containing Dicer. In another embodiment, binding of the miRNA binding site to the corresponding miRNA in RISC degrades the mRNA containing the miRNA binding site or prevents the mRNA from being translated. In some embodiments, the miRNA binding site has sufficient complementarity to miRNA so that a RISC complex comprising the miRNA cleaves the polynucleotide comprising the miRNA binding site. In other embodiments, the miRNA binding site has imperfect complementarity so that a RISC complex comprising the miRNA induces instability in the polynucleotide comprising the miRNA binding site. In another embodiment, the miRNA binding site has imperfect complementarity so that a RISC complex comprising the miRNA represses transcription of the polynucleotide comprising the miRNA binding site.

In some embodiments, the miRNA binding site has one, two, three, four, five, six, seven, eight, nine, ten, eleven or twelve mismatch(es) from the corresponding miRNA.

In some embodiments, the miRNA binding site has at least about ten, at least about eleven, at least about twelve, at least about thirteen, at least about fourteen, at least about fifteen, at least about sixteen, at least about seventeen, at least about eighteen, at least about nineteen, at least about twenty, or at least about twenty-one contiguous nucleotides complementary to at least about ten, at least about eleven, at least about twelve, at least about thirteen, at least about fourteen, at least about fifteen, at least about sixteen, at least about seventeen, at least about eighteen, at least about nineteen, at least about twenty, or at least about twenty-one, respectively, contiguous nucleotides of the corresponding miRNA.

By engineering one or more miRNA binding sites into a polynucleotide of the disclosure, the polynucleotide can be targeted for degradation or reduced translation, provided the miRNA in question is available. This can reduce off-target effects upon delivery of the polynucleotide. For example, if a polynucleotide of the disclosure is not intended to be delivered to a tissue or cell but ends up there, then a miRNA abundant in the tissue or cell can inhibit the expression of the gene of interest if one or multiple binding sites of the miRNA are engineered into the 5'UTR and/or 3'UTR of the polynucleotide.

Conversely, miRNA binding sites can be removed from polynucleotide sequences in which they naturally occur in order to increase protein expression in specific tissues. For example, a binding site for a specific miRNA can be removed from a polynucleotide to improve protein expression in tissues or cells containing the miRNA.

In one embodiment, a polynucleotide of the disclosure can include at least one miRNA-binding site in the 5'UTR and/or 3'UTR in order to direct cytotoxic or cytoprotective mRNA therapeutics to specific cells such as, but not limited to, normal and/or cancerous cells. In another embodiment, a polynucleotide of the disclosure can include two, three, four, five, six, seven, eight, nine, ten, or more miRNA-binding sites in the 5'-UTR and/or 3'-UTR in order to direct cytotoxic or cytoprotective mRNA therapeutics to specific cells such as, but not limited to, normal and/or cancerous cells.

Regulation of expression in multiple tissues can be accomplished through introduction or removal of one or more miRNA binding sites. The decision whether to remove or insert a miRNA binding site can be made based on miRNA expression patterns and/or their profilings in diseases. Identification of miRNAs, miRNA binding sites, and their expression patterns and role in biology have been reported (e.g., Bonauer et al., Curr Drug Targets 2010 11:943-949; Anand and Cheresh Curr Opin Hematol 2011 18:171-176; Contreras and Rao Leukemia 2012 26:404-413 (2011 Dec. 20. doi: 10.1038/1eu.2011.356); Bartel Cell 2009 136:215-233; Landgraf et al, Cell, 2007 129:1401-1414; Gentner and Naldini, Tissue Antigens. 2012 80:393-403 and all references therein; each of which is incorporated herein by reference in its entirety).

miRNAs and miRNA binding sites can correspond to any known sequence, including non-limiting examples described in U.S. Publication Nos. 2014/0200261, 2005/

0261218, and 2005/0059005, each of which are incorporated herein by reference in their entirety.

Examples of tissues where miRNA are known to regulate mRNA, and thereby protein expression, include, but are not limited to, liver (miR-122), muscle (miR-133, miR-206, miR-208), endothelial cells (miR-17-92, miR-126), myeloid cells (miR-142-3p, miR-142-5p, miR-16, miR-21, miR-223, miR-24, miR-27), adipose tissue (let-7, miR-30c), heart (miR-1d, miR-149), kidney (miR-192, miR-194, miR-204), and lung epithelial cells (let-7, miR-133, miR-126).

Some microRNAs, e.g., miR-122, are abundant in normal tissue but are present in much lower levels in cancer or tumor tissue. Thus, engineering microRNA target sequences (i.e., microRNA binding site) into the polynucleotides of the disclosure can effectively target the molecule for degradation or reduced translation in normal tissue (where the microRNA is abundant) while providing high levels of translation in the cancer or tumor tissue (where the microRNA is present in much lower levels). This provides a tumor-targeting approach for the methods and compositions of the disclosure.

Further examples of the miRNA binding sites that can be useful for the present disclosure include immune cell specific miRNAs including, but not limited to, hsa-let-7a-2-3p, hsa-let-7a-3p, hsa-7a-5p, hsa-let-7c, hsa-let-7e-3p, hsa-let-7e-5p, hsa-let-7g-3p, hsa-let-7g-5p, hsa-let-7i-3p, hsa-let-7i-5p, miR-10a-3p, miR-10a-5p, miR-1184, hsa-let-7f-1-3p, hsa-let-7f-2-5p, hsa-let-7f-5p, miR-125b-1-3p, miR-125b-2-3p, miR-125b-5p, miR-1279, miR-130a-3p, miR-130a-5p, miR-132-3p, miR-132-5p, miR-142-3p, miR-142-5p, miR-143-3p, miR-143-5p, miR-146a-3p, miR-146a-5p, miR-146b-3p, miR-146b-5p, miR-147a, miR-147b, miR-148a-5p, miR-148a-3p, miR-150-3p, miR-150-5p, miR-151b, miR-155-3p, miR-155-5p, miR-15a-3p, miR-15a-5p, miR-15b-5p, miR-15b-3p, miR-16-1-3p, miR-16-2-3p, miR-16-5p, miR-17-5p, miR-181a-3p, miR-181a-5p, miR-181a-2-3p, miR-182-3p, miR-182-5p, miR-197-3p, miR-197-5p, miR-21-5p, miR-21-3p, miR-214-3p, miR-214-5p, miR-223-3p, miR-223-5p, miR-221-3p, miR-221-5p, miR-23b-3p, miR-23b-5p, miR-24-1-5p, miR-24-2-5p, miR-24-3p, miR-26a-1-3p, miR-26a-2-3p, miR-26a-5p, miR-26b-3p, miR-26b-5p, miR-27a-3p, miR-27a-5p, miR-27b-3p, miR-27b-5p, miR-28-3p, miR-28-5p, miR-2909, miR-29a-3p, miR-29a-5p, miR-29b-1-5p, miR-29b-2-5p, miR-29c-3p, miR-29c-5p, miR-30e-3p, miR-30e-5p, miR-331-5p, miR-339-3p, miR-339-5p, miR-345-3p, miR-345-5p, miR-346, miR-34a-3p, miR-34a-5p, miR-363-3p, miR-363-5p, miR-372, miR-377-3p, miR-377-5p, miR-493-3p, miR-493-5p, miR-542, miR-548b-5p, miR548c-5p, miR-548i, miR-548j, miR-548n, miR-574-3p, miR-598, miR-718, miR-935, miR-99a-3p, miR-99a-5p, miR-99b-3p, and miR-99b-5p. Furthermore, novel miRNAs can be identified in immune cell through micro-array hybridization and microtome analysis (e.g., Jima D D et al, Blood, 2010, 116:e118-e127; Vaz C et al., BMC Genomics, 2010, 11,288, the content of each of which is incorporated herein by reference in its entirety.)

MiRNAs that are known to be expressed in the liver include, but are not limited to, miR-107, miR-122-3p, miR-122-5p, miR-1228-3p, miR-1228-5p, miR-1249, miR-129-5p, miR-1303, miR-151a-3p, miR-151a-5p, miR-152, miR-194-3p, miR-194-5p, miR-199a-3p, miR-199a-5p, miR-199b-3p, miR-199b-5p, miR-296-5p, miR-557, miR-581, miR-939-3p, and miR-939-5p. MiRNA binding sites from any liver specific miRNA can be introduced to or removed from a polynucleotide of the disclosure to regulate expression of the polynucleotide in the liver. Liver specific miRNA binding sites can be engineered alone or further in combination with immune cell (e.g., APC) miRNA binding sites in a polynucleotide of the disclosure.

MiRNAs that are known to be expressed in the lung include, but are not limited to, let-7a-2-3p, let-7a-3p, let-7a-5p, miR-126-3p, miR-126-5p, miR-127-3p, miR-127-5p, miR-130a-3p, miR-130a-5p, miR-130b-3p, miR-130b-5p, miR-133a, miR-133b, miR-134, miR-18a-3p, miR-18a-5p, miR-18b-3p, miR-18b-5p, miR-24-1-5p, miR-24-2-5p, miR-24-3p, miR-296-3p, miR-296-5p, miR-32-3p, miR-337-3p, miR-337-5p, miR-381-3p, and miR-381-5p. MiRNA binding sites from any lung specific miRNA can be introduced to or removed from a polynucleotide of the disclosure to regulate expression of the polynucleotide in the lung. Lung specific miRNA binding sites can be engineered alone or further in combination with immune cell (e.g., APC) miRNA binding sites in a polynucleotide of the disclosure.

MiRNAs that are known to be expressed in the heart include, but are not limited to, miR-1, miR-133a, miR-133b, miR-149-3p, miR-149-5p, miR-186-3p, miR-186-5p, miR-208a, miR-208b, miR-210, miR-296-3p, miR-320, miR-451a, miR-451b, miR-499a-3p, miR-499a-5p, miR-499b-3p, miR-499b-5p, miR-744-3p, miR-744-5p, miR-92b-3p, and miR-92b-5p. MiRNA binding sites from any heart specific microRNA can be introduced to or removed from a polynucleotide of the disclosure to regulate expression of the polynucleotide in the heart. Heart specific miRNA binding sites can be engineered alone or further in combination with immune cell (e.g., APC) miRNA binding sites in a polynucleotide of the disclosure.

MiRNAs that are known to be expressed in the nervous system include, but are not limited to, miR-124-5p, miR-125a-3p, miR-125a-5p, miR-125b-1-3p, miR-125b-2-3p, miR-125b-5p, miR-1271-3p, miR-1271-5p, miR-128, miR-132-5p, miR-135a-3p, miR-135a-5p, miR-135b-3p, miR-135b-5p, miR-137, miR-139-5p, miR-139-3p, miR-149-3p, miR-149-5p, miR-153, miR-181c-3p, miR-181c-5p, miR-183-3p, miR-183-5p, miR-190a, miR-190b, miR-212-3p, miR-212-5p, miR-219-1-3p, miR-219-2-3p, miR-23a-3p, miR-23a-5p, miR-30a-5p, miR-30b-3p, miR-30b-5p, miR-30c-1-3p, miR-30c-2-3p, miR-30c-5p, miR-30d-3p, miR-30d-5p, miR-329, miR-342-3p, miR-3665, miR-3666, miR-380-3p, miR-380-5p, miR-383, miR-410, miR-425-3p, miR-425-5p, miR-454-3p, miR-454-5p, miR-483, miR-510, miR-516a-3p, miR-548b-5p, miR-548c-5p, miR-571, miR-7-1-3p, miR-7-2-3p, miR-7-5p, miR-802, miR-922, miR-9-3p, and miR-9-5p. MiRNAs enriched in the nervous system further include those specifically expressed in neurons, including, but not limited to, miR-132-3p, miR-132-3p, miR-148b-3p, miR-148b-5p, miR-151a-3p, miR-151a-5p, miR-212-3p, miR-212-5p, miR-320b, miR-320e, miR-323a-3p, miR-323a-5p, miR-324-5p, miR-325, miR-326, miR-328, miR-922 and those specifically expressed in glial cells, including, but not limited to, miR-1250, miR-219-1-3p, miR-219-2-3p, miR-219-5p, miR-23a-3p, miR-23a-5p, miR-3065-3p, miR-3065-5p, miR-30e-3p, miR-30e-5p, miR-32-5p, miR-338-5p, and miR-657. MiRNA binding sites from any CNS specific miRNA can be introduced to or removed from a polynucleotide of the disclosure to regulate expression of the polynucleotide in the nervous system. Nervous system specific miRNA binding sites can be engineered alone or further in combination with immune cell (e.g., APC) miRNA binding sites in a polynucleotide of the disclosure.

MiRNAs that are known to be expressed in the pancreas include, but are not limited to, miR-105-3p, miR-105-5p, miR-184, miR-195-3p, miR-195-5p, miR-196a-3p, miR- 196a-5p, miR-214-3p, miR-214-5p, miR-216a-3p, miR-216a-5p, miR-30a-3p, miR-33a-3p, miR-33a-5p, miR-375, miR-7-1-3p, miR-7-2-3p, miR-493-3p, miR-493-5p, and miR-944. MiRNA binding sites from any pancreas specific miRNA can be introduced to or removed from a polynucleotide of the disclosure to regulate expression of the polynucleotide in the pancreas. Pancreas specific miRNA binding sites can be engineered alone or further in combination with immune cell (e.g. APC) miRNA binding sites in a polynucleotide of the disclosure.

MiRNAs that are known to be expressed in the kidney include, but are not limited to, miR-122-3p, miR-145-5p, miR-17-5p, miR-192-3p, miR-192-5p, miR-194-3p, miR-194-5p, miR-20a-3p, miR-20a-5p, miR-204-3p, miR-204-5p, miR-210, miR-216a-3p, miR-216a-5p, miR-296-3p, miR-30a-3p, miR-30a-5p, miR-30b-3p, miR-30b-5p, miR-30c-1-3p, miR-30c-2-3p, miR30c-5p, miR-324-3p, miR-335-3p, miR-335-5p, miR-363-3p, miR-363-5p, and miR-562. MiRNA binding sites from any kidney specific miRNA can be introduced to or removed from a polynucleotide of the disclosure to regulate expression of the polynucleotide in the kidney. Kidney specific miRNA binding sites can be engineered alone or further in combination with immune cell (e.g., APC) miRNA binding sites in a polynucleotide of the disclosure.

MiRNAs that are known to be expressed in the muscle include, but are not limited to, let-7g-3p, let-7g-5p, miR-1, miR-1286, miR-133a, miR-133b, miR-140-3p, miR-143-3p, miR-143-5p, miR-145-3p, miR-145-5p, miR-188-3p, miR-188-5p, miR-206, miR-208a, miR-208b, miR-25-3p, and miR-25-5p. MiRNA binding sites from any muscle specific miRNA can be introduced to or removed from a polynucleotide of the disclosure to regulate expression of the polynucleotide in the muscle. Muscle specific miRNA binding sites can be engineered alone or further in combination with immune cell (e.g., APC) miRNA binding sites in a polynucleotide of the disclosure.

MiRNAs are also differentially expressed in different types of cells, such as, but not limited to, endothelial cells, epithelial cells, and adipocytes.

MiRNAs that are known to be expressed in endothelial cells include, but are not limited to, let-7b-3p, let-7b-5p, miR-100-3p, miR-100-5p, miR-101-3p, miR-101-5p, miR-126-3p, miR-126-5p, miR-1236-3p, miR-1236-5p, miR-130a-3p, miR-130a-5p, miR-17-5p, miR-17-3p, miR-18a-3p, miR-18a-5p, miR-19a-3p, miR-19a-5p, miR-19b-1-5p, miR-19b-2-5p, miR-19b-3p, miR-20a-3p, miR-20a-5p, miR-217, miR-210, miR-21-3p, miR-21-5p, miR-221-3p, miR-221-5p, miR-222-3p, miR-222-5p, miR-23a-3p, miR-23a-5p, miR-296-5p, miR-361-3p, miR-361-5p, miR-421, miR-424-3p, miR-424-5p, miR-513a-5p, miR-92a-1-5p, miR-92a-2-5p, miR-92a-3p, miR-92b-3p, and miR-92b-5p. Many novel miRNAs are discovered in endothelial cells from deep-sequencing analysis (e.g., Voellenkle C et al., RNA, 2012, 18, 472-484, herein incorporated by reference in its entirety). MiRNA binding sites from any endothelial cell specific miRNA can be introduced to or removed from a polynucleotide of the disclosure to regulate expression of the polynucleotide in the endothelial cells.

MiRNAs that are known to be expressed in epithelial cells include, but are not limited to, let-7b-3p, let-7b-5p, miR-1246, miR-200a-3p, miR-200a-5p, miR-200b-3p, miR-200b-5p, miR-200c-3p, miR-200c-5p, miR-338-3p, miR-429, miR-451a, miR-451b, miR-494, miR-802 and miR-34a, miR-34b-5p, miR-34c-5p, miR-449a, miR-449b-3p, miR-449b-5p specific in respiratory ciliated epithelial cells, let-7 family, miR-133a, miR-133b, miR-126 specific in lung epithelial cells, miR-382-3p, miR-382-5p specific in renal epithelial cells, and miR-762 specific in corneal epithelial cells. MiRNA binding sites from any epithelial cell specific miRNA can be introduced to or removed from a polynucleotide of the disclosure to regulate expression of the polynucleotide in the epithelial cells.

In addition, a large group of miRNAs are enriched in embryonic stem cells, controlling stem cell self-renewal as well as the development and/or differentiation of various cell lineages, such as neural cells, cardiac, hematopoietic cells, skin cells, osteogenic cells and muscle cells (e.g., Kuppusamy K T et al., Curr. Mol Med, 2013, 13(5), 757-764; Vidigal J A and Ventura A, Semin Cancer Biol. 2012, 22(5-6), 428-436; Goff L A et al., PLoS One, 2009, 4:e7192; Morin R D et al., Genome Res, 2008,18, 610-621; Yoo J K et al., Stem Cells Dev. 2012, 21(11), 2049-2057, each of which is herein incorporated by reference in its entirety). MiRNAs abundant in embryonic stem cells include, but are not limited to, let-7a-2-3p, let-a-3p, let-7a-5p, let7d-3p, let-7d-5p, miR-103a-2-3p, miR-103a-5p, miR-106b-3p, miR-106b-5p, miR-1246, miR-1275, miR-138-1-3p, miR-138-2-3p, miR-138-5p, miR-154-3p, miR-154-5p, miR-200c-3p, miR-200c-5p, miR-290, miR-301a-3p, miR-301a-5p, miR-302a-3p, miR-302a-5p, miR-302b-3p, miR-302b-5p, miR-302c-3p, miR-302c-5p, miR-302d-3p, miR-302d-5p, miR-302e, miR-367-3p, miR-367-5p, miR-369-3p, miR-369-5p, miR-370, miR-371, miR-373, miR-380-5p, miR-423-3p, miR-423-5p, miR-486-5p, miR-520c-3p, miR-548e, miR-548f, miR-548g-3p, miR-548g-5p, miR-548i, miR-548k, miR-5481, miR-548m, miR-548n, miR-548o-3p, miR-548o-5p, miR-548p, miR-664a-3p, miR-664a-5p, miR-664b-3p, miR-664b-5p, miR-766-3p, miR-766-5p, miR-885-3p, miR-885-5p, miR-93-3p, miR-93-5p, miR-941, miR-96-3p, miR-96-5p, miR-99b-3p and miR-99b-5p. Many predicted novel miRNAs are discovered by deep sequencing in human embryonic stem cells (e.g., Morin R D et al., Genome Res, 2008,18, 610-621; Goff L A et al., PLoS One, 2009, 4:e7192; Bar M et al., Stem cells, 2008, 26, 2496-2505, the content of each of which is incorporated herein by reference in its entirety).

In one embodiment, the binding sites of embryonic stem cell specific miRNAs can be included in or removed from the 3'UTR of a polynucleotide of the disclosure to modulate the development and/or differentiation of embryonic stem cells, to inhibit the senescence of stem cells in a degenerative condition (e.g. degenerative diseases), or to stimulate the senescence and apoptosis of stem cells in a disease condition (e.g. cancer stem cells).

MiRNA can also regulate complex biological processes such as angiogenesis (e.g., miR-132) (Anand and Cheresh Curr Opin Hematol 2011 18:171-176). In the polynucleotides of the disclosure, miRNA binding sites that are involved in such processes can be removed or introduced, in order to tailor the expression of the polynucleotides to biologically relevant cell types or relevant biological processes. In this context, the polynucleotides of the disclosure are defined as auxotrophic polynucleotides.

In some embodiments, the microRNA binding site (e.g., miR-122 binding site) is fully complementary to miRNA (e.g., miR-122), thereby degrading the mRNA fused to the miRNA binding site. In other embodiments, the miRNA binding site is not fully complementary to the corresponding miRNA. In certain embodiments, the miRNA binding site (e.g., miR-122 binding site) is the same length as the corresponding miRNA (e.g., miR-122). In other embodiments, the microRNA binding site (e.g., miR-122 binding site) is one nucleotide shorter than the corresponding microRNA (e.g., miR-122, which has 22 nts) at the 5' terminus, the 3' terminus, or both. In still other embodiments, the microRNA binding site (e.g., miR-122 binding site) is two nucleotides shorter than the corresponding microRNA (e.g., miR-122) at the 5' terminus, the 3' terminus, or both. In yet other embodiments, the microRNA binding site (e.g., miR-122 binding site) is three nucleotides shorter than the corresponding microRNA (e.g., miR-122) at the 5' terminus, the 3' terminus, or both. In some embodiments, the microRNA binding site (e.g., miR-122 binding site) is four nucleotides shorter than the corresponding microRNA (e.g., miR-122) at the 5' terminus, the 3' terminus, or both. In other embodiments, the microRNA binding site (e.g., miR-122 binding site) is five nucleotides shorter than the corresponding microRNA (e.g., miR-122) at the 5' terminus, the 3' terminus, or both. In some embodiments, the microRNA binding site (e.g., miR-122 binding site) is six nucleotides shorter than the corresponding microRNA (e.g., miR-122) at the 5' terminus, the 3' terminus, or both. In other embodiments, the microRNA binding site (e.g., miR-122 binding site) is seven nucleotides shorter than the corresponding microRNA (e.g., miR-122) at the 5' terminus or the 3' terminus. In other embodiments, the microRNA binding site (e.g., miR-122 binding site) is eight nucleotides shorter than the corresponding microRNA (e.g., miR-122) at the 5' terminus or the 3' terminus. In other embodiments, the microRNA binding site (e.g., miR-122 binding site) is nine nucleotides shorter than the corresponding microRNA (e.g., miR-122) at the 5' terminus or the 3' terminus. In other embodiments, the microRNA binding site (e.g., miR-122 binding site) is ten nucleotides shorter than the corresponding microRNA (e.g., miR-122) at the 5' terminus or the 3' terminus. In other embodiments, the microRNA binding site (e.g., miR-122 binding site) is eleven nucleotides shorter than the corresponding microRNA (e.g., miR-122) at the 5' terminus or the 3' terminus. In other embodiments, the microRNA binding site (e.g., miR-122 binding site) is twelve nucleotides shorter than the corresponding microRNA (e.g., miR-122) at the 5' terminus or the 3' terminus. The miRNA binding sites that are shorter than the corresponding miRNAs are still capable of degrading the mRNA incorporating one or more of the miRNA binding sites or preventing the mRNA from translation.

In some embodiments, the microRNA binding site (e.g., miR-122 binding site) has sufficient complementarity to miRNA (e.g., miR-122) so that a RISC complex comprising the miRNA (e.g., miR-122) cleaves the polynucleotide comprising the microRNA binding site. In other embodiments, the microRNA binding site (e.g., miR-122 binding site) has imperfect complementarity so that a RISC complex comprising the miRNA (e.g., miR-122) induces instability in the polynucleotide comprising the microRNA binding site. In another embodiment, the microRNA binding site (e.g., miR-122 binding site) has imperfect complementarity so that a RISC complex comprising the miRNA (e.g., miR-122) represses transcription of the polynucleotide comprising the microRNA binding site. In one embodiment, the miRNA binding site (e.g., miR-122 binding site) has one mismatch from the corresponding miRNA (e.g., miR-122). In another embodiment, the miRNA binding site has two mismatches from the corresponding miRNA. In other embodiments, the miRNA binding site has three mismatches from the corresponding miRNA. In other embodiments, the miRNA binding site has four mismatches from the corresponding miRNA. In some embodiments, the miRNA binding site has five mismatches from the corresponding miRNA. In other embodiments, the miRNA binding site has six mismatches from the corresponding miRNA. In certain embodiments, the miRNA binding site has seven mismatches from the corresponding miRNA. In other embodiments, the miRNA binding site has eight mismatches from the corresponding miRNA. In other embodiments, the miRNA binding site has nine mismatches from the corresponding miRNA. In other embodiments, the miRNA binding site has ten mismatches from the corresponding miRNA. In other embodiments, the miRNA binding site has eleven mismatches from the corresponding miRNA. In other embodiments, the miRNA binding site has twelve mismatches from the corresponding miRNA.

In certain embodiments, the miRNA binding site (e.g., miR-122 binding site) has at least about ten contiguous nucleotides complementary to at least about ten contiguous nucleotides of the corresponding miRNA (e.g., miR-122), at least about eleven contiguous nucleotides complementary to at least about eleven contiguous nucleotides of the corresponding miRNA, at least about twelve contiguous nucleotides complementary to at least about twelve contiguous nucleotides of the corresponding miRNA, at least about thirteen contiguous nucleotides complementary to at least about thirteen contiguous nucleotides of the corresponding miRNA, or at least about fourteen contiguous nucleotides complementary to at least about fourteen contiguous nucleotides of the corresponding miRNA. In some embodiments, the miRNA binding sites have at least about fifteen contiguous nucleotides complementary to at least about fifteen contiguous nucleotides of the corresponding miRNA, at least about sixteen contiguous nucleotides complementary to at least about sixteen contiguous nucleotides of the corresponding miRNA, at least about seventeen contiguous nucleotides complementary to at least about seventeen contiguous nucleotides of the corresponding miRNA, at least about eighteen contiguous nucleotides complementary to at least about eighteen contiguous nucleotides of the corresponding miRNA, at least about nineteen contiguous nucleotides complementary to at least about nineteen contiguous nucleotides of the corresponding miRNA, at least about twenty contiguous nucleotides complementary to at least about twenty contiguous nucleotides of the corresponding miRNA, or at least about twenty one contiguous nucleotides complementary to at least about twenty one contiguous nucleotides of the corresponding miRNA.

In some embodiments, the polynucleotides of the disclosure comprise at least one miR122 binding site, at least two miR122 binding sites, at least three miR122 binding sites, at least four miR122 binding sites, or at least five miR122 binding sites. In one aspect, the miRNA binding site binds miR-122 or is complementary to miR-122. In another aspect, the miRNA binding site binds to miR-122-3p or miR-122-5p. In a particular aspect, the miRNA binding site comprises a nucleotide sequence at least 80%, at least 85%, at least 90%, at least 95%, or 100% identical to SEQ ID NO: 52 or 54, wherein the miRNA binding site binds to miR-122. In another particular aspect, the miRNA binding site comprises a nucleotide sequence at least 80%, at least 85%, at least 90%, at least 95%, or 100% identical to SEQ ID NO: 54, wherein the miRNA binding site binds to miR-122 (e.g., with sufficient strength to induce RISC-mediated cleavage of the polynucleotide, e.g., mRNA, comprising the miRNA binding site). In another particular aspect, the miRNA binding site has less than 3 substitutions, less than 2 substitutions, or less than 1 substitution as compared to the miRNA binding site as set forth as SEQ ID NO: 54, wherein the miR binding site binds to miR-122 (e.g., with sufficient strength to induce RISC-mediated cleavage of the polynucleotide, e.g., mRNA, comprising the miRNA binding site).

In some embodiments, a miRNA binding site (e.g., miR-122 binding site) is inserted in the polynucleotide of the disclosure in any position of the polynucleotide (e.g., 3' UTR); the insertion site in the polynucleotide can be anywhere in the polynucleotide as long as the insertion of the miRNA binding site in the polynucleotide does not interfere with the translation of the functional IL-12 polypeptide or the translation of the functional membrane domain in the absence of the corresponding miRNA (e.g., miR122); and in the presence of the miRNA (e.g., miR122), the insertion of the miRNA binding site in the polynucleotide and the binding of the miRNA binding site to the corresponding miRNA are capable of degrading the polynucleotide or preventing the translation of the polynucleotide. In one embodiment, a miRNA binding site is inserted in a 3'UTR of the polynucleotide.

In certain embodiments, a miRNA binding site is inserted in at least about 30 nucleotides downstream from a stop codon in a polynucleotide of the disclosure. In other embodiments, a miRNA binding site is inserted in at least about 10 nucleotides, at least about 15 nucleotides, at least about 20 nucleotides, at least about 25 nucleotides, at least about 30 nucleotides, at least about 35 nucleotides, at least about 40 nucleotides, at least about 45 nucleotides, at least about 50 nucleotides, at least about 55 nucleotides, at least about 60 nucleotides, at least about 65 nucleotides, at least about 70 nucleotides, at least about 75 nucleotides, at least about 80 nucleotides, at least about 85 nucleotides, at least about 90 nucleotides, at least about 95 nucleotides, or at least about 100 nucleotides downstream from a stop codon in a polynucleotide of the disclosure. In other embodiments, a miRNA binding site is inserted in about 10 nucleotides to about 100 nucleotides, about 20 nucleotides to about 90 nucleotides, about 30 nucleotides to about 80 nucleotides, about 40 nucleotides to about 70 nucleotides, about 50 nucleotides to about 60 nucleotides, about 45 nucleotides to about 65 nucleotides downstream from the stop codon in a polynucleotide of the disclosure. In some embodiments, the miRNA binding site is inserted downstream of the stop codon in the nucleic acid sequence encoding an IL-12 polypeptide as disclosed herein. In some embodiments, the miRNA binding site is inserted downstream of the stop codon in the nucleic acid sequence encoding membrane domain as disclosed herein. In some embodiments, the miRNA binding site is inserted downstream of the stop codon in the nucleic acid sequence encoding heterologous polypeptide as disclosed herein In some embodiments, a miRNA binding site is inserted in the polynucleotide of the disclosure in any position of the polynucleotide (e.g., the 5'UTR and/or 3'UTR). In some embodiments, the 5'UTR comprises a miRNA binding site. In some embodiments, the 3'UTR comprises a miRNA binding site. In some embodiments, the 5'UTR and the 3'UTR comprise a miRNA binding site. The insertion site in the polynucleotide can be anywhere in the polynucleotide as long as the insertion of the miRNA binding site in the polynucleotide does not interfere with the translation of a functional polypeptide in the absence of the corresponding miRNA; and in the presence of the miRNA, the insertion of the miRNA binding site in the polynucleotide and the binding of the miRNA binding site to the corresponding miRNA are capable of degrading the polynucleotide or preventing the translation of the polynucleotide.

In some embodiments, a miRNA binding site is inserted in at least about 30 nucleotides downstream from the stop codon of an ORF in a polynucleotide of the disclosure comprising the ORF. In some embodiments, a miRNA binding site is inserted in at least about 10 nucleotides, at least about 15 nucleotides, at least about 20 nucleotides, at least about 25 nucleotides, at least about 30 nucleotides, at least about 35 nucleotides, at least about 40 nucleotides, at least about 45 nucleotides, at least about 50 nucleotides, at least about 55 nucleotides, at least about 60 nucleotides, at least about 65 nucleotides, at least about 70 nucleotides, at least about 75 nucleotides, at least about 80 nucleotides, at least about 85 nucleotides, at least about 90 nucleotides, at least about 95 nucleotides, or at least about 100 nucleotides downstream from the stop codon of an ORF in a polynucleotide of the disclosure. In some embodiments, a miRNA binding site is inserted in about 10 nucleotides to about 100 nucleotides, about 20 nucleotides to about 90 nucleotides, about 30 nucleotides to about 80 nucleotides, about 40 nucleotides to about 70 nucleotides, about 50 nucleotides to about 60 nucleotides, about 45 nucleotides to about 65 nucleotides downstream from the stop codon of an ORF in a polynucleotide of the disclosure.

MiRNA gene regulation can be influenced by the sequence surrounding the miRNA such as, but not limited to, the species of the surrounding sequence, the type of sequence (e.g., heterologous, homologous, exogenous, endogenous, or artificial), regulatory elements in the surrounding sequence and/or structural elements in the surrounding sequence. The miRNA can be influenced by the 5'UTR and/or 3'UTR. As a non-limiting example, a non-human 3'UTR can increase the regulatory effect of the miRNA sequence on the expression of a polypeptide of interest compared to a human 3'UTR of the same sequence type.

In one embodiment, other regulatory elements and/or structural elements of the 5'UTR can influence miRNA mediated gene regulation. One example of a regulatory element and/or structural element is a structured IRES (Internal Ribosome Entry Site) in the 5'UTR, which is necessary for the binding of translational elongation factors to initiate protein translation. EIF4A2 binding to this secondarily structured element in the 5'-UTR is necessary for miRNA mediated gene expression (Meijer H A et al., *Science,* 2013, 340, 82-85, herein incorporated by reference in its entirety). The polynucleotides of the disclosure can further include this structured 5'UTR in order to enhance microRNA mediated gene regulation.

At least one miRNA binding site can be engineered into the 3'UTR of a polynucleotide of the disclosure. In this context, at least two, at least three, at least four, at least five, at least six, at least seven, at least eight, at least nine, at least ten, or more miRNA binding sites can be engineered into a 3'UTR of a polynucleotide of the disclosure. For example, 1 to 10, 1 to 9, 1 to 8, 1 to 7, 1 to 6, 1 to 5, 1 to 4, 1 to 3, 2, or 1 miRNA binding sites can be engineered into the 3'UTR of a polynucleotide of the disclosure. In one embodiment, miRNA binding sites incorporated into a polynucleotide of the disclosure can be the same or can be different miRNA sites. A combination of different miRNA binding sites incorporated into a polynucleotide of the disclosure can include combinations in which more than one copy of any of the different miRNA sites are incorporated. In another embodiment, miRNA binding sites incorporated into a polynucleotide of the disclosure can target the same or different tissues in the body. As a non-limiting example, through the introduction of tissue-, cell-type-, or disease-specific miRNA binding sites in the 3'-UTR of a polynucleotide of the disclosure, the degree of expression in specific cell types (e.g., hepatocytes, myeloid cells, endothelial cells, cancer cells, etc.) can be reduced.

In one embodiment, a miRNA binding site can be engineered near the 5' terminus of the 3'UTR, about halfway between the 5' terminus and 3' terminus of the 3'UTR and/or near the 3' terminus of the 3'UTR in a polynucleotide of the disclosure. As a non-limiting example, a miRNA binding site can be engineered near the 5' terminus of the 3'UTR and about halfway between the 5' terminus and 3' terminus of the 3'UTR. As another non-limiting example, a miRNA binding site can be engineered near the 3' terminus of the 3'UTR and about halfway between the 5' terminus and 3' terminus of the 3'UTR. As yet another non-limiting example, a miRNA binding site can be engineered near the 5' terminus of the 3'UTR and near the 3' terminus of the 3'UTR.

In another embodiment, a 3'UTR can comprise 1, 2, 3, 4, 5, 6, 7, 8, 9, or 10 miRNA binding sites. The miRNA binding sites can be complementary to a miRNA, miRNA seed sequence, and/or miRNA sequences flanking the seed sequence.

In one embodiment, a polynucleotide of the disclosure can be engineered to include more than one miRNA site expressed in different tissues or different cell types of a subject. As a non-limiting example, a polynucleotide of the disclosure can be engineered to include miR-192 and miR-122 to regulate expression of the polynucleotide in the liver and kidneys of a subject. In another embodiment, a polynucleotide of the disclosure can be engineered to include more than one miRNA site for the same tissue.

In some embodiments, the therapeutic window and or differential expression associated with the polypeptide encoded by a polynucleotide of the disclosure can be altered with a miRNA binding site. For example, a polynucleotide encoding a polypeptide that provides a death signal can be designed to be more highly expressed in cancer cells by virtue of the miRNA signature of those cells. Where a cancer cell expresses a lower level of a particular miRNA, the polynucleotide encoding the binding site for that miRNA (or miRNAs) would be more highly expressed. Hence, the polypeptide that provides a death signal triggers or induces cell death in the cancer cell. Neighboring non-cancer cells, harboring a higher expression of the same miRNA would be less affected by the encoded death signal as the polynucleotide would be expressed at a lower level due to the effects of the miRNA binding to the binding site or "sensor" encoded in the 3'UTR. Conversely, cell survival or cytoprotective signals can be delivered to tissues containing cancer and non-cancerous cells where a miRNA has a higher expression in the cancer cells—the result being a lower survival signal to the cancer cell and a larger survival signal to the normal cell. Multiple polynucleotides can be designed and administered having different signals based on the use of miRNA binding sites as described herein.

In some embodiments, the expression of a polynucleotide of the disclosure can be controlled by incorporating at least one sensor sequence in the polynucleotide and formulating the polynucleotide for administration. As a non-limiting example, a polynucleotide of the disclosure can be targeted to a tissue or cell by incorporating a miRNA binding site and formulating the polynucleotide in a lipid nanoparticle comprising a cationic lipid, including any of the lipids described herein.

A polynucleotide of the disclosure can be engineered for more targeted expression in specific tissues, cell types, or biological conditions based on the expression patterns of miRNAs in the different tissues, cell types, or biological conditions. Through introduction of tissue-specific miRNA binding sites, a polynucleotide of the disclosure can be designed for optimal protein expression in a tissue or cell, or in the context of a biological condition.

In some embodiments, a polynucleotide of the disclosure can be designed to incorporate miRNA binding sites that either have 100% identity to known miRNA seed sequences or have less than 100% identity to miRNA seed sequences. In some embodiments, a polynucleotide of the disclosure can be designed to incorporate miRNA binding sites that have at least: 60%, 65%, 70%, 75%, 80%, 85%, 90%, 95%, 96%, 97%, 98%, or 99% identity to known miRNA seed sequences. The miRNA seed sequence can be partially mutated to decrease miRNA binding affinity and as such result in reduced down modulation of the polynucleotide. In essence, the degree of match or mismatch between the miRNA binding site and the miRNA seed can act as a rheostat to more finely tune the ability of the miRNA to modulate protein expression. In addition, mutation in the non-seed region of a miRNA binding site can also impact the ability of a miRNA to modulate protein expression.

In one embodiment, a miRNA sequence can be incorporated into the loop of a stem loop.

In another embodiment, a miRNA seed sequence can be incorporated in the loop of a stem loop and a miRNA binding site can be incorporated into the 5' or 3' stem of the stem loop.

In one embodiment, a translation enhancer element (TEE) can be incorporated on the 5'end of the stem of a stem loop and a miRNA seed can be incorporated into the stem of the stem loop. In another embodiment, a TEE can be incorporated on the 5' end of the stem of a stem loop, a miRNA seed can be incorporated into the stem of the stem loop and a miRNA binding site can be incorporated into the 3' end of the stem or the sequence after the stem loop. The miRNA seed and the miRNA binding site can be for the same and/or different miRNA sequences.

In one embodiment, the incorporation of a miRNA sequence and/or a TEE sequence changes the shape of the stem loop region which can increase and/or decrease translation. (see e.g., Kedde et al., "A Pumilio-induced RNA structure switch in p27-3'UTR controls miR-221 and miR-22 accessibility." Nature Cell Biology. 2010, incorporated herein by reference in its entirety).

In one embodiment, the 5'-UTR of a polynucleotide of the disclosure can comprise at least one miRNA sequence. The miRNA sequence can be, but is not limited to, a 19 or 22 nucleotide sequence and/or a miRNA sequence without the seed.

In one embodiment the miRNA sequence in the 5'UTR can be used to stabilize a polynucleotide of the disclosure described herein.

In another embodiment, a miRNA sequence in the 5'UTR of a polynucleotide of the disclosure can be used to decrease the accessibility of the site of translation initiation such as, but not limited to a start codon. See, e.g., Matsuda et al., PLoS One. 2010 11(5):e15057; incorporated herein by reference in its entirety, which used antisense locked nucleic acid (LNA) oligonucleotides and exon-junction complexes (EJCs) around a start codon (−4 to +37 where the A of the AUG codons is +1) in order to decrease the accessibility to the first start codon (AUG). Matsuda showed that altering the sequence around the start codon with an LNA or EJC affected the efficiency, length and structural stability of a polynucleotide. A polynucleotide of the disclosure can comprise a miRNA sequence, instead of the LNA or EJC sequence described by Matsuda et al, near the site of translation initiation in order to decrease the accessibility to the site of translation initiation. The site of translation initiation can be prior to, after or within the miRNA sequence. As a non-limiting example, the site of translation initiation can be located within a miRNA sequence such as a seed sequence or binding site. As another non-limiting example, the site of translation initiation may be located within a miR-122 sequence such as the seed sequence or the mir-122 binding site.

In some embodiments, a polynucleotide of the disclosure can include at least one miRNA in order to dampen expression of the encoded polypeptide in a tissue or cell of interest. As a non-limiting example, a polynucleotide of the disclosure can include at least one miR-122 binding site in order to dampen expression of an encoded polypeptide of interest in the liver. As another non-limiting example a polynucleotide of the disclosure can include at least one miR-142-3p binding site, miR-142-3p seed sequence, miR-142-3p binding site without the seed, miR-142-5p binding site, miR-142-5p seed sequence, miR-142-5p binding site without the seed, miR-146 binding site, miR-146 seed sequence and/or miR-146 binding site without the seed sequence.

In some embodiments, a polynucleotide of the disclosure can comprise at least one miRNA binding site in the 3'UTR in order to selectively degrade mRNA therapeutics in the immune cells to subdue unwanted immunogenic reactions caused by therapeutic delivery. As a non-limiting example, the miRNA binding site can make a polynucleotide of the disclosure more unstable in antigen presenting cells. Non-limiting examples of these miRNAs include mir-122-5p or mir-122-3p.

In one embodiment, a polynucleotide of the disclosure comprises at least one miRNA sequence in a region of the polynucleotide that can interact with a RNA binding protein.

In some embodiments, the polynucleotide of the disclosure (e.g., a RNA, e.g., an mRNA) comprises (i) a sequence-optimized nucleotide sequence encoding an IL-12 polypeptide (e.g., the wild-type sequence, functional fragment, or variant thereof), (ii) a sequence-optimized nucleotide sequence encoding a membrane domain, and (iii) a miRNA binding site (e.g., a miRNA binding site that binds to miR-122).

In some embodiments, the polynucleotide of the disclosure comprises a nucleobase-modified sequence and a miRNA binding site disclosed herein, e.g., a miRNA binding site that binds to miR-122. In some embodiments, the polynucleotides of the disclosure comprising a miRNA binding site are formulated with a delivery agent, e.g., a compound having the Formula (I).

16. 3' UTR and the AU Rich Elements

In certain embodiments, a polynucleotide of the present disclosure further comprises a 3' UTR.

3'-UTR is the section of mRNA that immediately follows the translation termination codon and often contains regulatory regions that post-transcriptionally influence gene expression. Regulatory regions within the 3'-UTR can influence polyadenylation, translation efficiency, localization, and stability of the mRNA. In one embodiment, the 3'-UTR useful for the disclosure comprises a binding site for regulatory proteins or microRNAs.

In certain embodiments, the 3' UTR useful for the polynucleotides of the disclosure comprises a 3'UTR selected from those shown in this application (e.g., SEQ ID NOs: 222-224). In some embodiments, the 3'UTR useful for the polynucleotides of the disclosure comprises a 3'UTR comprising the sequence set forth in SEQ ID NO: 283.

In certain embodiments, the 3' UTR sequence useful for the disclosure comprises a nucleotide sequence at least about 60%, at least about 70%, at least about 80%, at least about 90%, at least about 95%, at least about 96%, at least about 97%, at least about 98%, at least about 99%, or about 100% identical to a sequence selected from the group consisting of 3'UTR sequences listed herein and any combination thereof.

17. Regions Having a 5' Cap

The disclosure also includes a polynucleotide that comprises both a 5' Cap and a polynucleotide of the present disclosure.

The 5' cap structure of a natural mRNA is involved in nuclear export, increasing mRNA stability and binds the mRNA Cap Binding Protein (CBP), which is responsible for mRNA stability in the cell and translation competency through the association of CBP with poly(A) binding protein to form the mature cyclic mRNA species. The cap further assists the removal of 5' proximal introns during mRNA splicing.

Endogenous mRNA molecules can be 5'-end capped generating a 5'-ppp-5'-triphosphate linkage between a terminal guanosine cap residue and the 5'-terminal transcribed sense nucleotide of the mRNA molecule. This 5'-guanylate cap can then be methylated to generate an N7-methyl-guanylate residue. The ribose sugars of the terminal and/or anteterminal transcribed nucleotides of the 5' end of the mRNA can optionally also be 2'-O-methylated. 5'-decapping through hydrolysis and cleavage of the guanylate cap structure can target a nucleic acid molecule, such as an mRNA molecule, for degradation.

In some embodiments, the polynucleotides of the present disclosure incorporate a cap moiety.

In some embodiments, polynucleotides of the present disclosure comprise a non-hydrolyzable cap structure preventing decapping and thus increasing mRNA half-life. Because cap structure hydrolysis requires cleavage of 5'-ppp-5' phosphorodiester linkages, modified nucleotides can be used during the capping reaction. For example, a Vaccinia Capping Enzyme from New England Biolabs (Ipswich, Mass.) can be used with α-thio-guanosine nucleotides according to the manufacturer's instructions to create a phosphorothioate linkage in the 5'-ppp-5' cap. Additional modified guanosine nucleotides can be used such as α-methyl-phosphonate and seleno-phosphate nucleotides.

Additional modifications include, but are not limited to, 2'-O-methylation of the ribose sugars of 5'-terminal and/or 5'-anteterminal nucleotides of the polynucleotide (as mentioned above) on the 2'-hydroxyl group of the sugar ring. Multiple distinct 5'-cap structures can be used to generate the 5'-cap of a nucleic acid molecule, such as a polynucleotide that functions as an mRNA molecule. Cap analogs, which herein are also referred to as synthetic cap analogs, chemical caps, chemical cap analogs, or structural or functional cap analogs, differ from natural (i.e., endogenous, wild-type or physiological) 5'-caps in their chemical structure, while retaining cap function. Cap analogs can be chemically (i.e., non-enzymatically) or enzymatically synthesized and/or linked to the polynucleotides of the disclosure.

For example, the Anti-Reverse Cap Analog (ARCA) cap contains two guanines linked by a 5'-5'-triphosphate group, wherein one guanine contains an N7 methyl group as well as a 3'-O-methyl group (i.e., N7,3'-O-dimethyl-guanosine-5'- triphosphate-5'-guanosine (m⁷G-3'mppp-G; which may equivalently be designated 3'-O-Me-m7G(5')ppp(5')G). The 3'-O atom of the other, unmodified, guanine becomes linked to the 5'-terminal nucleotide of the capped polynucleotide. The N7- and 3'-O-methlyated guanine provides the terminal moiety of the capped polynucleotide. Another exemplary cap is mCAP, which is similar to ARCA but has a 2'-O-methyl group on guanosine (i.e., N7,2'-O-dimethyl-guanosine-5'-triphosphate-5'-guanosine, m⁷Gm-ppp-G).

In some embodiments, the cap is a dinucleotide cap analog. As a non-limiting example, the dinucleotide cap analog can be modified at different phosphate positions with a boranophosphate group or a phophoroselenoate group such as the dinucleotide cap analogs described in U.S. Pat. No. 8,519,110, the contents of which are herein incorporated by reference in its entirety.

In another embodiment, the cap is a cap analog is a N7-(4-chlorophenoxyethyl) substituted dinucleotide form of a cap analog known in the art and/or described herein. Non-limiting examples of a N7-(4-chlorophenoxyethyl) substituted dinucleotide form of a cap analog include a N7-(4-chlorophenoxyethyl)-G(5')ppp(5')G and a N7-(4-chlorophenoxyethyl)-m$^{3'-O}$G(5')ppp(5')G cap analog (See, e.g., the various cap analogs and the methods of synthesizing cap analogs described in Kore et al. Bioorganic & Medicinal Chemistry 2013 21:4570-4574; the contents of which are herein incorporated by reference in its entirety). In another embodiment, a cap analog of the present disclosure is a 4-chloro/bromophenoxyethyl analog.

While cap analogs allow for the concomitant capping of a polynucleotide or a region thereof, in an in vitro transcription reaction, up to 20% of transcripts can remain uncapped. This, as well as the structural differences of a cap analog from an endogenous 5'-cap structures of nucleic acids produced by the endogenous, cellular transcription machinery, can lead to reduced translational competency and reduced cellular stability.

Polynucleotides of the disclosure can also be capped post-manufacture (whether IVT or chemical synthesis), using enzymes, in order to generate more authentic 5'-cap structures. As used herein, the phrase "more authentic" refers to a feature that closely mirrors or mimics, either structurally or functionally, an endogenous or wild type feature. That is, a "more authentic" feature is better representative of an endogenous, wild-type, natural or physiological cellular function and/or structure as compared to synthetic features or analogs, etc., of the prior art, or which outperforms the corresponding endogenous, wild-type, natural or physiological feature in one or more respects. Non-limiting examples of more authentic 5'cap structures of the present disclosure are those that, among other things, have enhanced binding of cap binding proteins, increased half-life, reduced susceptibility to 5' endonucleases and/or reduced 5'decapping, as compared to synthetic 5'cap structures known in the art (or to a wild-type, natural or physiological 5'cap structure). For example, recombinant Vaccinia Virus Capping Enzyme and recombinant 2'-O-methyltransferase enzyme can create a canonical 5'-5'-triphosphate linkage between the 5'-terminal nucleotide of a polynucleotide and a guanine cap nucleotide wherein the cap guanine contains an N7 methylation and the 5'-terminal nucleotide of the mRNA contains a 2'-O-methyl. Such a structure is termed the Cap1 structure. This cap results in a higher translational-competency and cellular stability and a reduced activation of cellular pro-inflammatory cytokines as compared, e.g., to other 5'cap analog structures known in the art. Cap structures include, but are not limited to, 7mG(5')ppp(5')N,pN2p (cap 0), 7mG(5')ppp(5')NlmpNp (cap 1), and 7mG(5')-ppp(5')NlmpN2mp (cap 2).

As a non-limiting example, capping chimeric polynucleotides post-manufacture can be more efficient as nearly 100% of the chimeric polynucleotides can be capped. This is in contrast to ~80% when a cap analog is linked to a chimeric polynucleotide in the course of an in vitro transcription reaction.

According to the present disclosure, 5' terminal caps can include endogenous caps or cap analogs. According to the present disclosure, a 5' terminal cap can comprise a guanine analog. Useful guanine analogs include, but are not limited to, inosine, N1-methyl-guanosine, 2'fluoro-guanosine, 7-deaza-guanosine, 8-oxo-guanosine, 2-amino-guanosine, LNA-guanosine, and 2-azidoguanosine.

18. Poly-A Tails

In some embodiments, the polynucleotides of the present disclosure further comprise a poly-A tail. In further embodiments, terminal groups on the poly-A tail can be incorporated for stabilization. In other embodiments, a poly-A tail comprises des-3' hydroxyl tails.

During RNA processing, a long chain of adenine nucleotides (poly-A tail) can be added to a polynucleotide such as an mRNA molecule in order to increase stability. Immediately after transcription, the 3' end of the transcript can be cleaved to free a 3' hydroxyl. Then poly-A polymerase adds a chain of adenine nucleotides to the RNA. The process, called polyadenylation, adds a poly-A tail that can be between, for example, approximately 80 to approximately 250 residues long, including approximately 80, 90, 100, 110, 120, 130, 140, 150, 160, 170, 180, 190, 200, 210, 220, 230, 240 or 250 residues long.

PolyA tails can also be added after the construct is exported from the nucleus.

According to the present disclosure, terminal groups on the polyA tail can be incorporated for stabilization. Polynucleotides of the present disclosure can include des-3' hydroxyl tails. They can also include structural moieties or 2'-Omethyl modifications as taught by Junjie Li, et al. (Current Biology, Vol. 15, 1501-1507, Aug. 23, 2005, the contents of which are incorporated herein by reference in its entirety).

The polynucleotides of the present disclosure can be designed to encode transcripts with alternative polyA tail structures including histone mRNA. According to Norbury, "Terminal uridylation has also been detected on human replication-dependent histone mRNAs. The turnover of these mRNAs is thought to be important for the prevention of potentially toxic histone accumulation following the completion or inhibition of chromosomal DNA replication. These mRNAs are distinguished by their lack of a 3' poly(A) tail, the function of which is instead assumed by a stable stem-loop structure and its cognate stem-loop binding protein (SLBP); the latter carries out the same functions as those of PABP on polyadenylated mRNAs" (Norbury, "Cytoplasmic RNA: a case of the tail wagging the dog," Nature Reviews Molecular Cell Biology; AOP, published online 29 Aug. 2013; doi:10.1038/nrm3645) the contents of which are incorporated herein by reference in its entirety.

Unique poly-A tail lengths provide certain advantages to the polynucleotides of the present disclosure. Generally, the length of a poly-A tail, when present, is greater than 30 nucleotides in length. In another embodiment, the poly-A tail is greater than 35 nucleotides in length (e.g., at least or greater than about 35, 40, 45, 50, 55, 60, 70, 80, 90, 100, 120, 140, 160, 180, 200, 250, 300, 350, 400, 450, 500, 600, 700, 800, 900, 1,000, 1,100, 1,200, 1,300, 1,400, 1,500, 1,600, 1,700, 1,800, 1,900, 2,000, 2,500, and 3,000 nucleotides).

In some embodiments, the polynucleotide or region thereof includes from about 30 to about 3,000 nucleotides (e.g., from 30 to 50, from 30 to 100, from 30 to 250, from 30 to 500, from 30 to 750, from 30 to 1,000, from 30 to 1,500, from 30 to 2,000, from 30 to 2,500, from 50 to 100, from 50 to 250, from 50 to 500, from 50 to 750, from 50 to 1,000, from 50 to 1,500, from 50 to 2,000, from 50 to 2,500, from 50 to 3,000, from 100 to 500, from 100 to 750, from 100 to 1,000, from 100 to 1,500, from 100 to 2,000, from 100 to 2,500, from 100 to 3,000, from 500 to 750, from 500 to 1,000, from 500 to 1,500, from 500 to 2,000, from 500 to 2,500, from 500 to 3,000, from 1,000 to 1,500, from 1,000 to 2,000, from 1,000 to 2,500, from 1,000 to 3,000, from 1,500 to 2,000, from 1,500 to 2,500, from 1,500 to 3,000, from 2,000 to 3,000, from 2,000 to 2,500, and from 2,500 to 3,000).

In some embodiments, the poly-A tail is designed relative to the length of the overall polynucleotide or the length of a particular region of the polynucleotide. This design can be based on the length of a coding region, the length of a particular feature or region or based on the length of the ultimate product expressed from the polynucleotides.

In this context, the poly-A tail can be 10, 20, 30, 40, 50, 60, 70, 80, 90, or 100% greater in length than the polynucleotide or feature thereof. The poly-A tail can also be designed as a fraction of the polynucleotides to which it belongs. In this context, the poly-A tail can be 10, 20, 30, 40, 50, 60, 70, 80, or 90% or more of the total length of the construct, a construct region or the total length of the construct minus the poly-A tail. Further, engineered binding sites and conjugation of polynucleotides for Poly-A binding protein can enhance expression.

Additionally, multiple distinct polynucleotides can be linked together via the PABP (Poly-A binding protein) through the 3'-end using modified nucleotides at the 3'-terminus of the poly-A tail. Transfection experiments can be conducted in relevant cell lines at and protein production can be assayed by ELISA at 12 hr, 24 hr, 48 hr, 72 hr and day 7 post-transfection.

In some embodiments, the polynucleotides of the present disclosure are designed to include a polyA-G Quartet region. The G-quartet is a cyclic hydrogen bonded array of four guanine nucleotides that can be formed by G-rich sequences in both DNA and RNA. In this embodiment, the G-quartet is incorporated at the end of the poly-A tail. The resultant polynucleotide is assayed for stability, protein production and other parameters including half-life at various time points. It has been discovered that the polyA-G quartet results in protein production from an mRNA equivalent to at least 75% of that seen using a poly-A tail of 120 nucleotides alone.

19. Start Codon Region

The disclosure also includes a polynucleotide that comprises both a start codon region and the polynucleotide described herein. In some embodiments, the polynucleotides of the present disclosure can have regions that are analogous to or function like a start codon region.

In some embodiments, the translation of a polynucleotide can initiate on a codon that is not the start codon AUG. Translation of the polynucleotide can initiate on an alternative start codon such as, but not limited to, ACG, AGG, AAG, CTG/CUG, GTG/GUG, ATA/AUA, ATT/AUU, TTG/UUG (see Touriol et al. Biology of the Cell 95 (2003) 169-178 and Matsuda and Mauro PLoS ONE, 2010 5:11; the contents of each of which are herein incorporated by reference in its entirety).

As a non-limiting example, the translation of a polynucleotide begins on the alternative start codon ACG. As another non-limiting example, polynucleotide translation begins on the alternative start codon CTG or CUG. As yet another non-limiting example, the translation of a polynucleotide begins on the alternative start codon GTG or GUG.

Nucleotides flanking a codon that initiates translation such as, but not limited to, a start codon or an alternative start codon, are known to affect the translation efficiency, the length and/or the structure of the polynucleotide. (See, e.g., Matsuda and Mauro PLoS ONE, 2010 5:11; the contents of which are herein incorporated by reference in its entirety). Masking any of the nucleotides flanking a codon that initiates translation can be used to alter the position of translation initiation, translation efficiency, length and/or structure of a polynucleotide.

In some embodiments, a masking agent can be used near the start codon or alternative start codon in order to mask or hide the codon to reduce the probability of translation initiation at the masked start codon or alternative start codon. Non-limiting examples of masking agents include antisense locked nucleic acids (LNA) polynucleotides and exon-junction complexes (EJCs) (See, e.g., Matsuda and Mauro describing masking agents LNA polynucleotides and EJCs (PLoS ONE, 2010 5:11); the contents of which are herein incorporated by reference in its entirety).

In another embodiment, a masking agent can be used to mask a start codon of a polynucleotide in order to increase the likelihood that translation will initiate on an alternative start codon. In some embodiments, a masking agent can be used to mask a first start codon or alternative start codon in order to increase the chance that translation will initiate on a start codon or alternative start codon downstream to the masked start codon or alternative start codon.

In some embodiments, a start codon or alternative start codon can be located within a perfect complement for a miR binding site. The perfect complement of a miR binding site can help control the translation, length and/or structure of the polynucleotide similar to a masking agent. As a non-limiting example, the start codon or alternative start codon can be located in the middle of a perfect complement for a miRNA binding site. The start codon or alternative start codon can be located after the first nucleotide, second nucleotide, third nucleotide, fourth nucleotide, fifth nucleotide, sixth nucleotide, seventh nucleotide, eighth nucleotide, ninth nucleotide, tenth nucleotide, eleventh nucleotide, twelfth nucleotide, thirteenth nucleotide, fourteenth nucleotide, fifteenth nucleotide, sixteenth nucleotide, seventeenth nucleotide, eighteenth nucleotide, nineteenth nucleotide, twentieth nucleotide or twenty-first nucleotide.

In another embodiment, the start codon of a polynucleotide can be removed from the polynucleotide sequence in order to have the translation of the polynucleotide begin on a codon that is not the start codon. Translation of the polynucleotide can begin on the codon following the removed start codon or on a downstream start codon or an alternative start codon. In a non-limiting example, the start codon ATG or AUG is removed as the first 3 nucleotides of the polynucleotide sequence in order to have translation initiate on a downstream start codon or alternative start codon. The polynucleotide sequence where the start codon was removed can further comprise at least one masking agent for the downstream start codon and/or alternative start codons in order to control or attempt to control the initiation of translation, the length of the polynucleotide and/or the structure of the polynucleotide.

20. Stop Codon Region

The disclosure also includes a polynucleotide that comprises both a stop codon region and the nucleic acid sequences described herein. In some embodiments, the polynucleotides of the present disclosure can include at least two stop codons before the 3' untranslated region (UTR). The stop codon can be selected from TGA, TAA and TAG in the case of DNA, or from UGA, UAA and UAG in the case of RNA. In some embodiments, the polynucleotides of the present disclosure include the stop codon TGA in the case or DNA, or the stop codon UGA in the case of RNA, and one additional stop codon. In a further embodiment the addition stop codon can be TAA or UAA. In another embodiment, the polynucleotides of the present disclosure include three consecutive stop codons, four stop codons, or more.

21. Insertions and Substitutions

The disclosure also includes a polynucleotide of the present disclosure that further comprises insertions and/or substitutions.

In some embodiments, the 5'UTR of the polynucleotide can be replaced by the insertion of at least one region and/or string of nucleosides of the same base. The region and/or string of nucleotides can include, but is not limited to, at least 3, at least 4, at least 5, at least 6, at least 7 or at least 8 nucleotides and the nucleotides can be natural and/or unnatural. As a non-limiting example, the group of nucleotides can include 5-8 adenine, cytosine, thymine, a string of any of the other nucleotides disclosed herein and/or combinations thereof.

In some embodiments, the 5'UTR of the polynucleotide can be replaced by the insertion of at least two regions and/or strings of nucleotides of two different bases such as, but not limited to, adenine, cytosine, thymine, any of the other nucleotides disclosed herein and/or combinations thereof. For example, the 5'UTR can be replaced by inserting 5-8 adenine bases followed by the insertion of 5-8 cytosine bases. In another example, the 5'UTR can be replaced by inserting 5-8 cytosine bases followed by the insertion of 5-8 adenine bases.

In some embodiments, the polynucleotide can include at least one substitution and/or insertion downstream of the transcription start site that can be recognized by an RNA polymerase. As a non-limiting example, at least one substitution and/or insertion can occur downstream of the transcription start site by substituting at least one nucleic acid in the region just downstream of the transcription start site (such as, but not limited to, +1 to +6). Changes to region of nucleotides just downstream of the transcription start site can affect initiation rates, increase apparent nucleotide triphosphate (NTP) reaction constant values, and increase the dissociation of short transcripts from the transcription complex curing initial transcription (Brieba et al, Biochemistry (2002) 41: 5144-5149; herein incorporated by reference in its entirety). The modification, substitution and/or insertion of at least one nucleoside can cause a silent mutation of the sequence or can cause a mutation in the amino acid sequence.

In some embodiments, the polynucleotide can include the substitution of at least 1, at least 2, at least 3, at least 4, at least 5, at least 6, at least 7, at least 8, at least 9, at least 10, at least 11, at least 12 or at least 13 guanine bases downstream of the transcription start site.

In some embodiments, the polynucleotide can include the substitution of at least 1, at least 2, at least 3, at least 4, at least 5 or at least 6 guanine bases in the region just downstream of the transcription start site. As a non-limiting example, if the nucleotides in the region are GGGAGA, the guanine bases can be substituted by at least 1, at least 2, at least 3 or at least 4 adenine nucleotides. In another non-limiting example, if the nucleotides in the region are GGGAGA the guanine bases can be substituted by at least 1, at least 2, at least 3 or at least 4 cytosine bases. In another non-limiting example, if the nucleotides in the region are GGGAGA the guanine bases can be substituted by at least 1, at least 2, at least 3 or at least 4 thymine, and/or any of the nucleotides described herein.

In some embodiments, the polynucleotide can include at least one substitution and/or insertion upstream of the start codon. For the purpose of clarity, one of skill in the art would appreciate that the start codon is the first codon of the protein coding region whereas the transcription start site is the site where transcription begins. The polynucleotide can include, but is not limited to, at least 1, at least 2, at least 3, at least 4, at least 5, at least 6, at least 7 or at least 8 substitutions and/or insertions of nucleotide bases. The nucleotide bases can be inserted or substituted at 1, at least 1, at least 2, at least 3, at least 4 or at least 5 locations upstream of the start codon. The nucleotides inserted and/or substituted can be the same base (e.g., all A or all C or all T or all G), two different bases (e.g., A and C, A and T, or C and T), three different bases (e.g., A, C and T or A, C and T) or at least four different bases.

As a non-limiting example, the guanine base upstream of the coding region in the polynucleotide can be substituted with adenine, cytosine, thymine, or any of the nucleotides described herein. In another non-limiting example the substitution of guanine bases in the polynucleotide can be designed so as to leave one guanine base in the region downstream of the transcription start site and before the start codon (see Esvelt et al. Nature (2011) 472(7344):499-503; the contents of which is herein incorporated by reference in its entirety). As a non-limiting example, at least 5 nucleotides can be inserted at 1 location downstream of the transcription start site but upstream of the start codon and the at least 5 nucleotides can be the same base type.

22. Polynucleotide Comprising an mRNA Encoding a Tethered IL-12 Polypeptide

In certain embodiments, a polynucleotide of the present disclosure, for example a polynucleotide comprising an mRNA nucleotide sequence encoding a tethered IL-12 polypeptide comprises from 5' to 3' end:
  (i) a 5' UTR, such as the sequences provided above, comprising a 5' cap provided above;
  (ii) a nucleic acid sequence encoding an IL-12 polypeptide disclosed herein, e.g., a nucleic acid sequence encoding IL-12B, a nucleic acid sequence encoding IL-12A, and, optionally, a nucleic acid sequence encoding a linker as disclosed herein that connects IL-12B and IL-12A, e.g., a sequence optimized nucleic acid sequence encoding an IL-12 polypeptide disclosed herein;

(iii) optionally, a nucleic acid sequence encoding a linker as disclosed herein that connects the IL-12 polypeptide to a membrane domain as disclosed herein;
(iv) a nucleic acid sequence encoding a membrane domain as disclosed herein, e.g., a transmembrane domain as disclosed herein, e.g., a Type I transmembrane domain, e.g., a CD8, CD80, or PDGF-R transmembrane domain;
(v) at least one stop codon;
(vi) a 3' UTR, such as the sequences provided above; and
(vii) a poly-A tail provided above.

In certain embodiments, a polynucleotide of the present disclosure, for example a polynucleotide comprising an mRNA nucleotide sequence encoding a tethered IL-12 polypeptide comprises from 5' to 3' end:
(i) a 5' UTR, such as the sequences provided above, comprising a 5' cap;
(ii) a nucleic acid sequence encoding a membrane domain as disclosed herein, e.g., a transmembrane domain as disclosed herein, e.g., a Type II transmembrane domain;
(iii) optionally, a nucleic acid sequence encoding a linker as disclosed herein that connects the membrane domain as disclosed herein to an IL-12 polypeptide as disclosed herein;
(iv) a nucleic acid sequence encoding an IL-12 polypeptide disclosed herein, e.g., a nucleic acid sequence encoding IL-12B, a nucleic acid sequence encoding IL-12A, and, optionally, a nucleic acid sequence encoding a linker as disclosed herein that connects IL-12B and IL-12A, e.g., a sequence optimized nucleic acid sequence encoding an IL-12 polypeptide disclosed herein;
(v) at least one stop codon;
(vi) a 3' UTR, such as the sequences provided above; and
(vii) a poly-A tail provided above.

In some embodiments, the polynucleotide further comprises a miRNA binding site, e.g., a miRNA binding site that binds to miRNA-122. In some embodiments, the 5'UTR comprises the miRNA binding site.

In some embodiments, a polynucleotide of the present disclosure comprises a nucleotide sequence encoding a polypeptide sequence at least 70%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identical to the protein sequence of a wild type IL-12 (e.g., isoform 1, 2, 3, or 4).

23. Methods of Making Polynucleotides

The present disclosure also provides methods for making a polynucleotide of the disclosure or a complement thereof.

In some aspects, a polynucleotide (e.g., a RNA, e.g., an mRNA) disclosed herein can be constructed using in vitro transcription. In other aspects, a polynucleotide (e.g., a RNA, e.g., an mRNA) disclosed herein can be constructed by chemical synthesis using an oligonucleotide synthesizer.

In other aspects, a polynucleotide (e.g., a RNA, e.g., an mRNA) disclosed herein is made by using a host cell. In certain aspects, a polynucleotide (e.g., a RNA, e.g., an mRNA) disclosed herein is made by one or more combination of the IVT, chemical synthesis, host cell expression, or any other methods known in the art. In other embodiments, a host cell is a eukaryotic cell, e.g., in vitro mammalian cells.

Naturally occurring nucleosides, non-naturally occurring nucleosides, or combinations thereof, can totally or partially naturally replace occurring nucleosides present in the candidate nucleotide sequence and can be incorporated into a sequence-optimized nucleotide sequence (e.g., a RNA, e.g., an mRNA) as disclosed herein. The resultant polynucleotides, e.g., mRNAs, can then be examined for their ability to produce protein and/or produce a therapeutic outcome.

a. In Vitro Transcription/Enzymatic Synthesis

The polynucleotides of the present disclosure disclosed herein can be transcribed using an in vitro transcription (IVT) system. The system typically comprises a transcription buffer, nucleotide triphosphates (NTPs), an RNase inhibitor and a polymerase. The NTPs can be selected from, but are not limited to, those described herein including natural and unnatural (modified) NTPs. The polymerase can be selected from, but is not limited to, T7 RNA polymerase, T3 RNA polymerase and mutant polymerases such as, but not limited to, polymerases able to incorporate polynucleotides disclosed herein. See U.S. Publ. No. US20130259923, which is herein incorporated by reference in its entirety.

Any number of RNA polymerases or variants can be used in the synthesis of the polynucleotides of the present disclosure. RNA polymerases can be modified by inserting or deleting amino acids of the RNA polymerase sequence. As a non-limiting example, the RNA polymerase can be modified to exhibit an increased ability to incorporate a 2'-modified nucleotide triphosphate compared to an unmodified RNA polymerase (see International Publication WO2008078180 and U.S. Pat. No. 8,101,385; herein incorporated by reference in their entireties).

Variants can be obtained by evolving an RNA polymerase, optimizing the RNA polymerase amino acid and/or nucleic acid sequence and/or by using other methods known in the art. As a non-limiting example, T7 RNA polymerase variants can be evolved using the continuous directed evolution system set out by Esvelt et al. (Nature 472:499-503 (2011); herein incorporated by reference in its entirety) where clones of T7 RNA polymerase can encode at least one mutation such as, but not limited to, lysine at position 93 substituted for threonine (K93T), I4M, A7T, E63V, V64D, A65E, D66Y, T76N, C125R, S128R, A136T, N165S, G175R, H176L, Y178H, F182L, L196F, G198V, D208Y, E222K, S228A, Q239R, T243N, G259D, M267I, G280C, H300R, D351A, A354S, E356D, L360P, A383V, Y385C, D388Y, S397R, M401T, N410S, K450R, P451T, G452V, E484A, H523L, H524N, G542V, E565K, K577E, K577M, N601S, S684Y, L699I, K713E, N748D, Q754R, E775K, A827V, D851N or L864F. As another non-limiting example, T7 RNA polymerase variants can encode at least mutation as described in U.S. Pub. Nos. 20100120024 and 20070117112; herein incorporated by reference in their entireties. Variants of RNA polymerase can also include, but are not limited to, substitutional variants, conservative amino acid substitution, insertional variants, deletional variants and/or covalent derivatives.

In one aspect, the polynucleotide can be designed to be recognized by the wild type or variant RNA polymerases. In doing so, the polynucleotide can be modified to contain sites or regions of sequence changes from the wild type or parent chimeric polynucleotide.

Polynucleotide or nucleic acid synthesis reactions can be carried out by enzymatic methods utilizing polymerases. Polymerases catalyze the creation of phosphodiester bonds between nucleotides in a polynucleotide or nucleic acid chain. Currently known DNA polymerases can be divided into different families based on amino acid sequence comparison and crystal structure analysis. DNA polymerase I (pol I) or A polymerase family, including the Klenow fragments of E. coli, Bacillus DNA polymerase I, Thermus aquaticus (Taq) DNA polymerases, and the T7 RNA and DNA polymerases, is among the best studied of these families. Another large family is DNA polymerase α (pol α) or B polymerase family, including all eukaryotic replicating DNA polymerases and polymerases from phages T4 and RB69. Although they employ similar catalytic mechanism, these families of polymerases differ in substrate specificity, substrate analog-incorporating efficiency, degree and rate for primer extension, mode of DNA synthesis, exonuclease activity, and sensitivity against inhibitors.

DNA polymerases are also selected based on the optimum reaction conditions they require, such as reaction temperature, pH, and template and primer concentrations. Sometimes a combination of more than one DNA polymerases is employed to achieve the desired DNA fragment size and synthesis efficiency. For example, Cheng et al. increase pH, add glycerol and dimethyl sulfoxide, decrease denaturation times, increase extension times, and utilize a secondary thermostable DNA polymerase that possesses a 3' to 5' exonuclease activity to effectively amplify long targets from cloned inserts and human genomic DNA. (Cheng et al., PNAS 91:5695-5699 (1994), the contents of which are incorporated herein by reference in their entirety). RNA polymerases from bacteriophage T3, T7, and SP6 have been widely used to prepare RNAs for biochemical and biophysical studies. RNA polymerases, capping enzymes, and poly-A polymerases are disclosed in the co-pending International Publication No. WO2014028429, the contents of which are incorporated herein by reference in their entirety.

In one aspect, the RNA polymerase which can be used in the synthesis of the polynucleotides of the present disclosure is a Syn5 RNA polymerase. (see Zhu et al. Nucleic Acids Research 2013, doi:10.1093/nar/gkt1193, which is herein incorporated by reference in its entirety). The Syn5 RNA polymerase was recently characterized from marine cyanophage Syn5 by Zhu et al. where they also identified the promoter sequence (see Zhu et al. Nucleic Acids Research 2013, the contents of which is herein incorporated by reference in its entirety). Zhu et al. found that Syn5 RNA polymerase catalyzed RNA synthesis over a wider range of temperatures and salinity as compared to T7 RNA polymerase. Additionally, the requirement for the initiating nucleotide at the promoter was found to be less stringent for Syn5 RNA polymerase as compared to the T7 RNA polymerase making Syn5 RNA polymerase promising for RNA synthesis.

In one aspect, a Syn5 RNA polymerase can be used in the synthesis of the polynucleotides described herein. As a non-limiting example, a Syn5 RNA polymerase can be used in the synthesis of the polynucleotide requiring a precise 3'-terminus.

In one aspect, a Syn5 promoter can be used in the synthesis of the polynucleotides. As a non-limiting example, the Syn5 promoter can be 5'-ATTGGGCACCCGTAAGGG-3' (SEQ ID NO: 47) as described by Zhu et al. (Nucleic Acids Research 2013).

In one aspect, a Syn5 RNA polymerase can be used in the synthesis of polynucleotides comprising at least one chemical modification described herein and/or known in the art (see e.g., the incorporation of pseudo-UTP and 5Me-CTP described in Zhu et al. Nucleic Acids Research 2013).

In one aspect, the polynucleotides described herein can be synthesized using a Syn5 RNA polymerase which has been purified using modified and improved purification procedure described by Zhu et al. (Nucleic Acids Research 2013).

Various tools in genetic engineering are based on the enzymatic amplification of a target gene which acts as a template. For the study of sequences of individual genes or specific regions of interest and other research needs, it is necessary to generate multiple copies of a target gene from a small sample of polynucleotides or nucleic acids. Such methods can be applied in the manufacture of the polynucleotides of the disclosure.

For example, polymerase chain reaction (PCR), strand displacement amplification (SDA), nucleic acid sequence-based amplification (NASBA), also called transcription mediated amplification (TMA), and/or rolling-circle amplification (RCA) can be utilized in the manufacture of one or more regions of the polynucleotides of the present invention.

Assembling polynucleotides or nucleic acids by a ligase is also widely used.

b. Chemical Synthesis

Standard methods can be applied to synthesize an isolated polynucleotide sequence encoding an isolated polypeptide of interest, such as a polynucleotide of the disclosure. For example, a single DNA or RNA oligomer containing a codon-optimized nucleotide sequence coding for the particular isolated polypeptide can be synthesized. In other aspects, several small oligonucleotides coding for portions of the desired polypeptide can be synthesized and then ligated. In some aspects, the individual oligonucleotides typically contain 5' or 3' overhangs for complementary assembly.

A polynucleotide disclosed herein (e.g., a RNA, e.g., an mRNA) can be chemically synthesized using chemical synthesis methods and potential nucleobase substitutions known in the art. See, for example, International Publication Nos. WO2014093924, WO2013052523; WO2013039857, WO2012135805, WO2013151671; U.S. Publ. No. US20130115272; or U.S. Pat. Nos. 8,999,380 or 8,710,200, all of which are herein incorporated by reference in their entireties.

c. Purification of Polynucleotides Encoding Tethered IL-12 Polypeptides

Purification of the polynucleotides described herein can include, but is not limited to, polynucleotide clean-up, quality assurance and quality control. Clean-up can be performed by methods known in the arts such as, but not limited to, AGENCOURT® beads (Beckman Coulter Genomics, Danvers, Mass.), poly-T beads, LNA™ oligo-T capture probes (EXIQON® Inc., Vedbaek, Denmark) or HPLC based purification methods such as, but not limited to, strong anion exchange HPLC, weak anion exchange HPLC, reverse phase HPLC (RP-HPLC), and hydrophobic interaction HPLC (HIC-HPLC).

The term "purified" when used in relation to a polynucleotide such as a "purified polynucleotide" refers to one that is separated from at least one contaminant. As used herein, a "contaminant" is any substance that makes another unfit, impure or inferior. Thus, a purified polynucleotide (e.g., DNA and RNA) is present in a form or setting different from that in which it is found in nature, or a form or setting different from that which existed prior to subjecting it to a treatment or purification method.

In some embodiments, purification of a polynucleotide of the disclosure removes impurities that can reduce or remove an unwanted immune response, e.g., reducing cytokine activity.

In some embodiments, the polynucleotide of the disclosure is purified prior to administration using column chromatography (e.g., strong anion exchange HPLC, weak anion exchange HPLC, reverse phase HPLC (RP-HPLC), and hydrophobic interaction HPLC (HIC-HPLC), or (LCMS)).

In some embodiments, the polynucleotide of the disclosure purified using column chromatography (e.g., strong anion exchange HPLC, weak anion exchange HPLC, reverse phase HPLC (RP-HPLC, hydrophobic interaction HPLC (HIC-HPLC), or (LCMS)) presents increased expression of the encoded IL-12 protein compared to the expression level obtained with the same polynucleotide of the present disclosure purified by a different purification method.

In some embodiments, a column chromatography (e.g., strong anion exchange HPLC, weak anion exchange HPLC, reverse phase HPLC (RP-HPLC), hydrophobic interaction HPLC (HIC-HPLC), or (LCMS)) purified polynucleotide comprises a nucleotide sequence encoding an IL-12 polypeptide comprising one or more of the point mutations known in the art.

In some embodiments, the use of RP-HPLC purified polynucleotide increases IL-12 protein expression levels in cells when introduced into those cells, e.g., by 10-100%, i.e., at least about 10%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 90%, at least about 95%, or at least about 100% with respect to the expression levels of IL-12 protein in the cells before the RP-HPLC purified polynucleotide was introduced in the cells, or after a non-RP-HPLC purified polynucleotide was introduced in the cells.

In some embodiments, the use of RP-HPLC purified polynucleotide increases functional IL-12 protein expression levels in cells when introduced into those cells, e.g., by 10-100%, i.e., at least about 10%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 90%, at least about 95%, or at least about 100% with respect to the functional expression levels of IL-12 protein in the cells before the RP-HPLC purified polynucleotide was introduced in the cells, or after a non-RP-HPLC purified polynucleotide was introduced in the cells.

In some embodiments, the use of RP-HPLC purified polynucleotide increases detectable IL-12 activity in cells when introduced into those cells, e.g., by 10-100%, i.e., at least about 10%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 90%, at least about 95%, or at least about 100% with respect to the activity levels of functional IL-12 in the cells before the RP-HPLC purified polynucleotide was introduced in the cells, or after a non-RP-HPLC purified polynucleotide was introduced in the cells.

In some embodiments, the purified polynucleotide is at least about 80% pure, at least about 85% pure, at least about 90% pure, at least about 95% pure, at least about 96% pure, at least about 97% pure, at least about 98% pure, at least about 99% pure, or about 100% pure.

A quality assurance and/or quality control check can be conducted using methods such as, but not limited to, gel electrophoresis, UV absorbance, or analytical HPLC. In another embodiment, the polynucleotide can be sequenced by methods including, but not limited to reverse-transcriptase-PCR.

d. Quantification of Expressed Polynucleotides Encoding Tethered IL-12 Polypeptides In some embodiments, the polynucleotides of the present disclosure, their expression products, as well as degradation products and metabolites can be quantified according to methods known in the art.

In some embodiments, the polynucleotides of the present disclosure can be quantified in exosomes or when derived from one or more bodily fluid. As used herein "bodily fluids" include peripheral blood, serum, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, cowper's fluid or pre-ejaculatory fluid, sweat, fecal matter, hair, tears, cyst fluid, pleural and peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates, blastocyl cavity fluid, and umbilical cord blood. Alternatively, exosomes can be retrieved from an organ selected from the group consisting of lung, heart, pancreas, stomach, intestine, bladder, kidney, ovary, testis, skin, colon, breast, prostate, brain, esophagus, liver, and placenta.

In the exosome quantification method, a sample of not more than 2 mL is obtained from the subject and the exosomes isolated by size exclusion chromatography, density gradient centrifugation, differential centrifugation, nanomembrane ultrafiltration, immunoabsorbent capture, affinity purification, microfluidic separation, or combinations thereof. In the analysis, the level or concentration of a polynucleotide can be an expression level, presence, absence, truncation or alteration of the administered construct. It is advantageous to correlate the level with one or more clinical phenotypes or with an assay for a human disease biomarker.

The assay can be performed using construct specific probes, cytometry, qRT-PCR, real-time PCR, PCR, flow cytometry, electrophoresis, mass spectrometry, or combinations thereof while the exosomes can be isolated using immunohistochemical methods such as enzyme linked immunosorbent assay (ELISA) methods. Exosomes may also be isolated by size exclusion chromatography, density gradient centrifugation, differential centrifugation, nanomembrane ultrafiltration, immunoabsorbent capture, affinity purification, microfluidic separation, or combinations thereof.

These methods afford the investigator the ability to monitor, in real time, the level of polynucleotides remaining or delivered. This is possible because the polynucleotides of the present disclosure differ from the endogenous forms due to the structural or chemical modifications. In some embodiments, the polynucleotide can be quantified using methods such as, but not limited to, ultraviolet visible spectroscopy (UV/Vis). A non-limiting example of a UV/Vis spectrometer is a NANODROP® spectrometer (ThermoFisher, Waltham, Mass.). The quantified polynucleotide can be analyzed in order to determine if the polynucleotide can be of proper size, check that no degradation of the polynucleotide has occurred. Degradation of the polynucleotide can be checked by methods such as, but not limited to, agarose gel electrophoresis, HPLC based purification methods such as, but not limited to, strong anion exchange HPLC, weak anion exchange HPLC, reverse phase HPLC (RP-HPLC), and hydrophobic interaction HPLC (HIC-HPLC), liquid chromatography-mass spectrometry (LCMS), capillary electrophoresis (CE) and capillary gel electrophoresis (CGE).

24. Pharmaceutical Compositions and Formulations

The present disclosure provides pharmaceutical compositions and formulations that comprise any of the polynucleotides described above. In some embodiments, the composition or formulation further comprises a delivery agent.

In some embodiments, the composition or formulation can contain a polynucleotide comprising a sequence optimized nucleic acid sequence disclosed herein which encodes a tethered IL-12 polypeptide comprising an IL-12 polypeptide as disclosed herein and a membrane domain as disclosed herein. In some embodiments, the composition or formulation can contain a polynucleotide (e.g., a RNA, e.g., an mRNA) comprising a nucleic acid sequence (e.g., an ORF) having significant sequence identity to a sequence optimized nucleic acid sequence disclosed herein which encodes an IL-12 polypeptide and/or a sequence optimized nucleic acid sequence disclosed herein which encodes a membrane domain. In some embodiments, the polynucleotide further comprises a miRNA binding site, e.g., a miRNA binding site that binds miR-122.

Pharmaceutical compositions or formulation can optionally comprise one or more additional active substances, e.g., therapeutically and/or prophylactically active substances. Pharmaceutical compositions or formulation of the present disclosure can be sterile and/or pyrogen-free. General considerations in the formulation and/or manufacture of pharmaceutical agents can be found, for example, in *Remington: The Science and Practice of Pharmacy* 21$^{st}$ ed., Lippincott Williams & Wilkins, 2005 (incorporated herein by reference in its entirety). In some embodiments, compositions are administered to humans, human patients or subjects. For the purposes of the present disclosure, the phrase "active ingredient" generally refers to polynucleotides to be delivered as described herein. Formulations and pharmaceutical compositions described herein can be prepared by any method known or hereafter developed in the art of pharmacology. In general, such preparatory methods include the step of associating the active ingredient with an excipient and/or one or more other accessory ingredients, and then, if necessary and/or desirable, dividing, shaping and/or packaging the product into a desired single- or multi-dose unit.

A pharmaceutical composition or formulation in accordance with the present disclosure can be prepared, packaged, and/or sold in bulk, as a single unit dose, and/or as a plurality of single unit doses. As used herein, a "unit dose" refers to a discrete amount of the pharmaceutical composition comprising a predetermined amount of the active ingredient. The amount of the active ingredient is generally equal to the dosage of the active ingredient that would be administered to a subject and/or a convenient fraction of such a dosage such as, for example, one-half or one-third of such a dosage. Relative amounts of the active ingredient, the pharmaceutically acceptable excipient, and/or any additional ingredients in a pharmaceutical composition in accordance with the present disclosure may vary, depending upon the identity, size, and/or condition of the subject being treated and further depending upon the route by which the composition is to be administered.

In some embodiments, the compositions and formulations described herein can contain at least one polynucleotide of the disclosure. As a non-limiting example, the composition or formulation can contain 1, 2, 3, 4 or 5 polynucleotides of the disclosure. In some embodiments, the compositions or formulations described herein can comprise more than one type of polynucleotide. In some embodiments, the composition or formulation can comprise a polynucleotide in linear and circular form. In another embodiment, the composition or formulation can comprise a circular polynucleotide and an IVT polynucleotide. In yet another embodiment, the composition or formulation can comprise an IVT polynucleotide, a chimeric polynucleotide and a circular polynucleotide.

Although the descriptions of pharmaceutical compositions and formulations provided herein are principally directed to pharmaceutical compositions and formulations that are suitable for administration to humans, it will be understood by the skilled artisan that such compositions are generally suitable for administration to any other animal, e.g., to non-human animals, e.g. non-human mammals.

The present disclosure provides pharmaceutical formulations that comprise a polynucleotide described herein. The polynucleotides described herein can be formulated using one or more excipients to:

(1) increase stability; (2) increase cell transfection; (3) permit the sustained or delayed release (e.g., from a depot formulation of the polynucleotide); (4) alter the biodistribution (e.g., target the polynucleotide to specific tissues or cell types); (5) increase the translation of encoded protein in vivo; and/or (6) alter the release profile of encoded protein in vivo. In some embodiments, the pharmaceutical formulation further comprises a delivery agent, (e.g., a compound having the Formula (I)).

A pharmaceutically acceptable excipient, as used herein, includes, but are not limited to, any and all solvents, dispersion media, or other liquid vehicles, dispersion or suspension aids, diluents, granulating and/or dispersing agents, surface active agents, isotonic agents, thickening or emulsifying agents, preservatives, binders, lubricants or oil, coloring, sweetening or flavoring agents, stabilizers, antioxidants, antimicrobial or antifungal agents, osmolality adjusting agents, pH adjusting agents, buffers, chelants, cyoprotectants, and/or bulking agents, as suited to the particular dosage form desired. Various excipients for formulating pharmaceutical compositions and techniques for preparing the composition are known in the art (see Remington: The Science and Practice of Pharmacy, 21st Edition, A. R. Gennaro (Lippincott, Williams & Wilkins, Baltimore, Md., 2006; incorporated herein by reference in its entirety).

Exemplary diluents include, but are not limited to, calcium or sodium carbonate, calcium phosphate, calcium hydrogen phosphate, sodium phosphate, lactose, sucrose, cellulose, microcrystalline cellulose, kaolin, mannitol, sorbitol, etc., and/or combinations thereof.

Exemplary granulating and/or dispersing agents include, but are not limited to, starches, pregelatinized starches, or microcrystalline starch, alginic acid, guar gum, agar, poly (vinyl-pyrrolidone), (providone), cross-linked poly(vinyl-pyrrolidone) (crospovidone), cellulose, methylcellulose, carboxymethyl cellulose, cross-linked sodium carboxymethyl cellulose (croscarmellose), magnesium aluminum silicate (VEEGUM®), sodium lauryl sulfate, etc., and/or combinations thereof.

Exemplary surface active agents and/or emulsifiers include, but are not limited to, natural emulsifiers (e.g., acacia, agar, alginic acid, sodium alginate, tragacanth, chondrux, cholesterol, xanthan, pectin, gelatin, egg yolk, casein, wool fat, cholesterol, wax, and lecithin), sorbitan fatty acid esters (e.g., polyoxyethylene sorbitan monooleate [TWEEN®80], sorbitan monopalmitate [SPAN®40], glyceryl monooleate, polyoxyethylene esters, polyethylene glycol fatty acid esters (e.g., CREMOPHOR®), polyoxyethylene ethers (e.g., polyoxyethylene lauryl ether [BRIJ®30]), PLUORINC® F 68, POLOXAMER®188, etc. and/or combinations thereof.

Exemplary binding agents include, but are not limited to, starch, gelatin, sugars (e.g., sucrose, glucose, dextrose, dextrin, molasses, lactose, lactitol, mannitol), amino acids (e.g., glycine), natural and synthetic gums (e.g., acacia, sodium alginate), ethylcellulose, hydroxyethylcellulose, hydroxypropyl methylcellulose, etc., and combinations thereof.

Oxidation is a potential degradation pathway for mRNA, especially for liquid mRNA formulations. In order to prevent oxidation, antioxidants can be added to the formulations. Exemplary antioxidants include, but are not limited to, alpha tocopherol, ascorbic acid, acorbyl palmitate, benzyl alcohol, butylated hydroxyanisole, m-cresol, methionine, butylated hydroxytoluene, monothioglycerol, sodium or potassium metabisulfite, propionic acid, propyl gallate, sodium ascorbate, etc., and combinations thereof.

Exemplary chelating agents include, but are not limited to, ethylenediaminetetraacetic acid (EDTA), citric acid monohydrate, disodium edetate, fumaric acid, malic acid, phosphoric acid, sodium edetate, tartaric acid, trisodium edetate, etc., and combinations thereof.

Exemplary antimicrobial or antifungal agents include, but are not limited to, benzalkonium chloride, benzethonium chloride, methyl paraben, ethyl paraben, propyl paraben, butyl paraben, benzoic acid, hydroxybenzoic acid, potassium or sodium benzoate, potassium or sodium sorbate, sodium propionate, sorbic acid, etc., and combinations thereof.

Exemplary preservatives include, but are not limited to, vitamin A, vitamin C, vitamin E, beta-carotene, citric acid, ascorbic acid, butylated hydroxyanisol, ethylenediamine, sodium lauryl sulfate (SLS), sodium lauryl ether sulfate (SLES), etc., and combinations thereof.

In some embodiments, the pH of polynucleotide solutions are maintained between pH 5 and pH 8 to improve stability. Exemplary buffers to control pH can include, but are not limited to sodium phosphate, sodium citrate, sodium succinate, histidine (or histidine-HCl), sodium malate, sodium carbonate, etc., and/or combinations thereof.

Exemplary lubricating agents include, but are not limited to, magnesium stearate, calcium stearate, stearic acid, silica, talc, malt, hydrogenated vegetable oils, polyethylene glycol, sodium benzoate, sodium or magnesium lauryl sulfate, etc., and combinations thereof.

The pharmaceutical composition or formulation described here may contain a cyroprotectant to stabilize a polynucleotide described herein during freezing. Exemplary cryoprotectants include, but are not limited to mannitol, sucrose, trehalose, lactose, glycerol, dextrose, etc., and combinations thereof.

The pharmaceutical composition or formulation described here may contain a bulking agent in lyophilized polynucleotide formulations to yield a "pharmaceutically elegant" cake, stabilize the lyophilized polynucleotides during long term (e.g., 36 month) storage. Exemplary bulking agents of the present disclosure can include, but are not limited to sucrose, trehalose, mannitol, glycine, lactose, raffinose, and combinations thereof.

In some embodiments, the pharmaceutical composition or formulation further comprises a delivery agent. The delivery agent of the present disclosure can include, without limitation, liposomes, lipid nanoparticles, lipidoids, polymers, lipoplexes, microvesicles, exosomes, peptides, proteins, cells transfected with polynucleotides, hyaluronidase, nanoparticle mimics, nanotubes, conjugates, and combinations thereof.

25. Delivery Agents a. Lipid Compound

The present disclosure provides pharmaceutical compositions with advantageous properties. In particular, the present application provides pharmaceutical compositions comprising:

(a) a polynucleotide comprising a nucleotide sequence encoding a tethered IL-12 polypeptide as disclosed herein; and (b) a delivery agent.

In one embodiment, the delivery agent for the present disclosure is a lipid nanoparticle. In another embodiment, the delivery agent comprises formula (I):

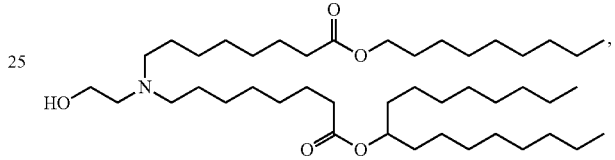

(Formula I)

In other embodiments, the delivery agent for the present disclosure comprises any one or more compounds disclosed in International Application No. PCT/US2016/052352, filed on Sep. 16, 2016 and published as WO 2017/2017/049245, which is incorporated herein by reference in its entirety.

Amine moieties of the lipid compounds disclosed herein can be protonated under certain conditions. For example, the central amine moiety of a lipid according to formula (I) is typically protonated (i.e., positively charged) at a pH below the pKa of the amino moiety and is substantially not charged at a pH above the pKa. Such lipids may be referred to ionizable amino lipids.

In one specific embodiment, the ionizable amino lipid is the compound of formula (I).

In some embodiments, the amount the ionizable amino lipid, e.g., compound of formula (I), ranges from about 1 mol % to 99 mol % in the lipid composition.

In one embodiment, the amount of the ionizable amino lipid, e.g., compound of formula (I), is at least about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, or 99 mol % in the lipid composition.

In one embodiment, the amount of the ionizable amino lipid, e.g., the compound of formula (I), ranges from about 30 mol % to about 70 mol %, from about 35 mol % to about 65 mol %, from about 40 mol % to about 60 mol %, and from about 45 mol % to about 55 mol % in the lipid composition.

In one specific embodiment, the amount of the compound of formula (I) is about 50 mol % in the lipid composition.

In addition to the compound of formula (I), the lipid composition of the pharmaceutical compositions disclosed herein can comprise additional components such as phospholipids, structural lipids, quaternary amine compounds, PEG-lipids, and any combination thereof.

b. Additional Components in the Lipid Composition
(i) Phospholipids

The lipid composition of the pharmaceutical composition disclosed herein can comprise one or more phospholipids, for example, one or more saturated or (poly)unsaturated phospholipids or a combination thereof. In general, phospholipids comprise a phospholipid moiety and one or more fatty acid moieties.

A phospholipid moiety may be selected, for example, from the non-limiting group consisting of phosphatidyl choline, phosphatidyl ethanolamine, phosphatidyl glycerol, phosphatidyl serine, phosphatidic acid, 2-lysophosphatidyl choline, and a sphingomyelin.

A fatty acid moiety may be selected, for example, from the non-limiting group consisting of lauric acid, myristic acid, myristoleic acid, palmitic acid, palmitoleic acid, stearic acid, oleic acid, linoleic acid, alpha-linolenic acid, erucic acid, phytanoic acid, arachidic acid, arachidonic acid, eicosapentaenoic acid, behenic acid, docosapentaenoic acid, and docosahexaenoic acid.

Particular phospholipids may facilitate fusion to a membrane. For example, a cationic phospholipid may interact with one or more negatively charged phospholipids of a membrane (e.g., a cellular or intracellular membrane). Fusion of a phospholipid to a membrane may allow one or more elements (e.g., a therapeutic agent) of a lipid-containing composition (e.g., LNPs) to pass through the membrane permitting, e.g., delivery of the one or more elements to a target tissue (e.g., tumoral tissue).

Non-natural phospholipid species including natural species with modifications and substitutions including branching, oxidation, cyclization, and alkynes are also contemplated. For example, a phospholipid may be functionalized with or cross-linked to one or more alkynes (e.g., an alkenyl group in which one or more double bonds is replaced with a triple bond). Under appropriate reaction conditions, an alkyne group may undergo a copper-catalyzed cycloaddition upon exposure to an azide. Such reactions may be useful in functionalizing a lipid bilayer of a nanoparticle composition to facilitate membrane permeation or cellular recognition or in conjugating a nanoparticle composition to a useful component such as a targeting or imaging moiety (e.g., a dye).

Phospholipids include, but are not limited to, glycerophospholipids such as phosphatidylcholines, phosphatidylethanolamines, phosphatidylserines, phosphatidylinositols, phosphatidy glycerols, and phosphatidic acids. Phospholipids also include phosphosphingolipid, such as sphingomyelin. In some embodiments, a pharmaceutical composition for intratumoral delivery disclosed herein can comprise more than one phospholipid. When more than one phospholipid is used, such phospholipids can belong to the same phospholipid class (e.g., MSPC and DSPC) or different classes (e.g., MSPC and MSPE).

Phospholipids may be of a symmetric or an asymmetric type. As used herein, the term "symmetric phospholipid" includes glycerophospholipids having matching fatty acid moieties and sphingolipids in which the variable fatty acid moiety and the hydrocarbon chain of the sphingosine backbone include a comparable number of carbon atoms. As used herein, the term "asymmetric phospholipid" includes lysolipids, glycerophospholipids having different fatty acid moieties (e.g., fatty acid moieties with different numbers of carbon atoms and/or unsaturations (e.g., double bonds)), and sphingolipids in which the variable fatty acid moiety and the hydrocarbon chain of the sphingosine backbone include a dissimilar number of carbon atoms (e.g., the variable fatty acid moiety include at least two more carbon atoms than the hydrocarbon chain or at least two fewer carbon atoms than the hydrocarbon chain).

In some embodiments, the lipid composition of a pharmaceutical composition disclosed herein comprises at least one symmetric phospholipid.

In some embodiments, the lipid composition of a pharmaceutical composition disclosed herein comprises at least one symmetric phospholipid selected from the non-limiting group consisting of DLPC, DMPC, DOPC, DPPC, DSPC, DUPC, 18:0 Diether PC, DLnPC, DAPC, DHAPC, DOPE, 4ME 16:0 PE, DSPE, DLPE, DLnPE, DAPE, DHAPE, DOPG, and any combination thereof.

In some embodiment, the lipid composition of a pharmaceutical composition disclosed herein comprises at least one asymmetric phospholipid selected from the group consisting of MPPC, MSPC, PMPC, PSPC, SMPC, SPPC, and any combination thereof. In some embodiments, the asymmetric phospholipid is 1-myristoyl-2-stearoyl-sn-glycero-3-phosphocholine (MSPC). In a particular embodiment, the asymmetric phospholipid is one or more phospholipid disclosed in International Application No. PCT/US17/27492, filed on Apr. 13, 2017, which is incorporated herein by reference in its entireties.

In some embodiments, the lipid compositions disclosed herein may contain one or more symmetric phospholipids, one or more asymmetric phospholipids, or a combination thereof. When multiple phospholipids are present, they can be present in equimolar ratios, or non-equimolar ratios.

In one embodiment, the lipid composition of a pharmaceutical composition disclosed herein comprises a total amount of phospholipid (e.g., MSPC) which ranges from about 1 mol % to about 20 mol %, from about 5 mol % to about 20 mol %, from about 10 mol % to about 20 mol %, from about 15 mol % to about 20 mol %, from about 1 mol % to about 15 mol %, from about 5 mol % to about 15 mol %, from about 10 mol % to about 15 mol %, from about 5 mol % to about 10 mol % in the lipid composition. In one embodiment, the amount of the phospholipid is from about 8 mol % to about 15 mol % in the lipid composition. In one embodiment, the amount of the phospholipid (e.g., MSPC) is about 10 mol % in the lipid composition.

In some aspects, the amount of a specific phospholipid (e.g., MSPC) is at least about 1, 2, 3, 4, 5, 6, 7, 8, 9, 10, 11, 12, 13, 14, 15, 16, 17, 18, 19 or 20 mol % in the lipid composition.

(ii) Quaternary Amine Compounds

The lipid composition of a pharmaceutical composition disclosed herein can comprise one or more quaternary amine compounds (e.g., DOTAP). The term "quaternary amine compound" is used to include those compounds having one or more quaternary amine groups (e.g., trialkylamino groups) and permanently carrying a positive charge and existing in a form of a salt. For example, the one or more quaternary amine groups can be present in a lipid or a polymer (e.g., PEG). In some embodiments, the quaternary amine compound comprises (1) a quaternary amine group and (2) at least one hydrophobic tail group comprising (i) a hydrocarbon chain, linear or branched, and saturated or unsaturated, and (ii) optionally an ether, ester, carbonyl, or ketal linkage between the quaternary amine group and the hydrocarbon chain. In some embodiments, the quaternary amine group can be a trimethylammonium group. In some embodiments, the quaternary amine compound comprises two identical hydrocarbon chains. In some embodiments, the quaternary amine compound comprises two different hydrocarbon chains.

In some embodiments, the lipid composition of a pharmaceutical composition disclosed herein comprises at least one quaternary amine compound. In one embodiment, the quaternary amine compound is 1,2-dioleoyl-3-trimethylammonium-propane (DOTAP).

Quaternary amine compounds are known in the art, such as those described in US 2013/0245107 A1, US 2014/0363493 A1, U.S. Pat. No. 8,158,601, WO 2015/123264 A1, and WO 2015/148247 A1, which are incorporated herein by reference in their entirety.

In one embodiment, the amount of the quaternary amine compound (e.g., DOTAP) in the lipid composition disclosed herein ranges from about 0.01 mol % to about 20 mol %.

In one embodiment, the amount of the quaternary amine compound (e.g., DOTAP) in the lipid composition disclosed herein ranges from about 0.5 mol % to about 20 mol %, from about 0.5 mol % to about 15 mol %, from about 0.5 mol % to about 10 mol %, from about 1 mol % to about 20 mol %, from about 1 mol % to about 15 mol %, from about 1 mol % to about 10 mol %, from about 2 mol % to about 20 mol %, from about 2 mol % to about 15 mol %, from about 2 mol % to about 10 mol %, from about 3 mol % to about 20 mol %, from about 3 mol % to about 15 mol %, from about 3 mol % to about 10 mol %, from about 4 mol % to about 20 mol %, from about 4 mol % to about 15 mol %, from about 4 mol % to about 10 mol %, from about 5 mol % to about 20 mol %, from about 5 mol % to about 15 mol %, from about 5 mol % to about 10 mol %, from about 6 mol % to about 20 mol %, from about 6 mol % to about 15 mol %, from about 6 mol % to about 10 mol %, from about 7 mol % to about 20 mol %, from about 7 mol % to about 15 mol %, from about 7 mol % to about 10 mol %, from about 8 mol % to about 20 mol %, from about 8 mol % to about 15 mol %, from about 8 mol % to about 10 mol %, from about 9 mol % to about 20 mol %, from about 9 mol % to about 15 mol %, from about 9 mol % to about 10 mol %.

In one embodiment, the amount of the quaternary amine compound (e.g., DOTAP) in the lipid composition disclosed herein ranges from about 5 mol % to about 10 mol %.

In one embodiment, the amount of the quaternary amine compound (e.g., DOTAP) in the lipid composition disclosed herein is about 5 mol %. In one embodiment, the amount of the quaternary amine compound (e.g., DOTAP) in the lipid composition disclosed herein is about 10 mol %.

In some embodiments, the amount of the quaternary amine compound (e.g., DOTAP) is at least about 0.01, 0.02, 0.03, 0.04, 0.05, 0.06, 0.07, 0.08, 0.09, 0.1, 0.2, 0.3, 0.4, 0.5, 0.6, 0.7, 0.8, 0.9, 1, 1.5, 2, 2.5, 3, 3.5, 4, 4.5, 5, 5.5, 6, 6.5, 7, 7.5, 8, 8.5, 9, 9.5, 10, 10.5, 11, 11.5, 12, 12.5, 13, 13.5, 14, 14.5, 15, 15.5, 16, 16.5, 17, 17.5, 18, 18.5, 19, 19.5 or 20 mol % in the lipid composition disclosed herein.

In some embodiments, the lipid composition of the pharmaceutical compositions disclosed herein comprises a compound of formula (I). In one embodiment, the mole ratio of the compound of formula (I) to the quaternary amine compound (e.g., DOTA) is about 100:1 to about 2.5:1. In one embodiment, the mole ratio of the compound of formula (I) to the quaternary amine compound (e.g., DOTAP) is about 90:1, about 80:1, about 70:1, about 60:1, about 50:1, about 40:1, about 30:1, about 20:1, about 15:1, about 10:1, about 9:1, about 8:1, about 7:1, about 6:1, about 5:1, or about 2.5:1. In one embodiment, the mole ratio of the compound of formula (I) to the quaternary amine compound (e.g., DOTAP) in the lipid composition disclosed herein is about 10:1.

In some aspects, the lipid composition of the pharmaceutical compositions disclosed herein does not comprise a quaternary amine compound. In some aspects, the lipid composition of the pharmaceutical compositions disclosed herein does not comprise DOTAP.

(iii) Structural Lipids

The lipid composition of a pharmaceutical composition disclosed herein can comprise one or more structural lipids. As used herein, the term "structural lipid" refers to sterols and also to lipids containing sterol moieties. In some embodiments, the structural lipid is selected from the group consisting of cholesterol, fecosterol, sitosterol, ergosterol, campesterol, stigmasterol, brassicasterol, tomatidine, tomatine, ursolic acid, alpha-tocopherol, and mixtures thereof. In some embodiments, the structural lipid is cholesterol.

In one embodiment, the amount of the structural lipid (e.g., an sterol such as cholesterol) in the lipid composition of a pharmaceutical composition disclosed herein ranges from about 20 mol % to about 60 mol %, from about 25 mol % to about 55 mol %, from about 30 mol % to about 50 mol %, or from about 35 mol % to about 45 mol %.

In one embodiment, the amount of the structural lipid (e.g., an sterol such as cholesterol) in the lipid composition disclosed herein ranges from about 25 mol % to about 30 mol %, from about 30 mol % to about 35 mol %, or from about 35 mol % to about 40 mol %.

In one embodiment, the amount of the structural lipid (e.g., a sterol such as cholesterol) in the lipid composition disclosed herein is about 23.5 mol %, about 28.5 mol %, about 33.5 mol %, or about 38.5 mol %.

In some embodiments, the amount of the structural lipid (e.g., an sterol such as cholesterol) in the lipid composition disclosed herein is at least about 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 mol %.

In some aspects, the lipid composition component of the pharmaceutical compositions for intratumoral delivery disclosed does not comprise cholesterol.

(iv) Polyethylene Glycol (PEG)-Lipids

The lipid composition of a pharmaceutical composition disclosed herein can comprise one or more a polyethylene glycol (PEG) lipid.

As used herein, the term "PEG-lipid" refers to polyethylene glycol (PEG)-modified lipids. Non-limiting examples of PEG-lipids include PEG-modified phosphatidylethanolamine and phosphatidic acid, PEG-ceramide conjugates (e.g., PEG-CerC14 or PEG-CerC20), PEG-modified dialkylamines and PEG-modified 1,2-diacyloxypropan-3-amines. Such lipids are also referred to as PEGylated lipids. For example, a PEG lipid may be PEG-c-DOMG, PEG-DMG, PEG-DLPE, PEG-DMPE, PEG-DPPC, or a PEG-DSPE lipid.

In some embodiments, the PEG-lipid includes, but not limited to 1,2-dimyristoyl-sn-glycerol methoxypolyethylene glycol (PEG-DMG), 1,2-distearoyl-sn-glycero-3-phosphoethanolamine-N-[amino(polyethylene glycol)] (PEG-DSPE), PEG-disteryl glycerol (PEG-DS G), PEG-dipalmetoleyl, PEG-dioleyl, PEG-distearyl, PEG-diacylglycamide (PEG-DAG), PEG-dipalmitoyl phosphatidylethanolamine (PEG-DPPE), or PEG-1,2-dimyristyloxlpropyl-3-amine (PEG-c-DMA).

In one embodiment, the PEG-lipid is selected from the group consisting of a PEG-modified phosphatidylethanolamine, a PEG-modified phosphatidic acid, a PEG-modified ceramide, a PEG-modified dialkylamine, a PEG-modified diacylglycerol, a PEG-modified dialkylglycerol, and mixtures thereof.

In some embodiments, the lipid moiety of the PEG-lipids includes those having lengths of from about $C_{14}$ to about $C_{22}$, preferably from about $C_{14}$ to about $C_{16}$. In some embodiments, a PEG moiety, for example an mPEG-NH$_2$, has a size of about 1000, 2000, 5000, 10,000, 15,000 or 20,000 daltons. In one embodiment, the PEG-lipid is PEG$_{2k}$-DMG.

In one embodiment, the lipid nanoparticles described herein may comprise a PEG lipid which is a non-diffusible PEG. Non-limiting examples of non-diffusible PEGs include PEG-DSG and PEG-DSPE.

PEG-lipids are known in the art, such as those described in U.S. Pat. No. 8,158,601 and International Publ. No. WO 2015/130584 A2, which are incorporated herein by reference in their entirety.

In one embodiment, the amount of PEG-lipid in the lipid composition of a pharmaceutical composition disclosed herein ranges from about 0.1 mol % to about 5 mol %, from about 0.5 mol % to about 5 mol %, from about 1 mol % to about 5 mol %, from about 1.5 mol % to about 5 mol %, from about 2 mol % to about 5 mol % mol %, from about 0.1 mol % to about 4 mol %, from about 0.5 mol % to about 4 mol %, from about 1 mol % to about 4 mol %, from about 1.5 mol % to about 4 mol %, from about 2 mol % to about 4 mol %, from about 0.1 mol % to about 3 mol %, from about 0.5 mol % to about 3 mol %, from about 1 mol % to about 3 mol %, from about 1.5 mol % to about 3 mol %, from about 2 mol % to about 3 mol %, from about 0.1 mol % to about 2 mol %, from about 0.5 mol % to about 2 mol %, from about 1 mol % to about 2 mol %, from about 1.5 mol % to about 2 mol %, from about 0.1 mol % to about 1.5 mol %, from about 0.5 mol % to about 1.5 mol %, or from about 1 mol % to about 1.5 mol %.

In one embodiment, the amount of PEG-lipid in the lipid composition disclosed herein is about 1.5 mol %.

In one embodiment, the amount of PEG-lipid in the lipid composition disclosed herein is at least about 0.1, 0.2, 0.3, 0.4, 0.5, 0.6, 0.7, 0.8, 0.9, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, 3.1, 3.2, 3.3, 3.4, 3.5, 3.6, 3.7, 3.8, 3.9, 4, 4.1, 4.2, 4.3, 4.4, 4.5, 4.6, 4.7, 4.8, 4.9, or 5 mol %.

In some aspects, the lipid composition of the pharmaceutical compositions disclosed herein does not comprise a PEG-lipid.

In some embodiments, the lipid composition disclosed herein comprises an ionizable amino lipid, e.g., compound of formula (I), and an asymmetric phospholipid. In some embodiments, the lipid composition comprises compound 18 and MSPC.

In some embodiments, the lipid composition disclosed herein comprises an ionizable amino lipid, e.g., compound of formula (I), and a quaternary amine compound. In some embodiments, the lipid composition comprises compound 18 and DOTAP.

In some embodiments, the lipid composition disclosed herein comprises an ionizable amino lipid, e.g., compound of formula (I), an asymmetric phospholipid, and a quaternary amine compound. In some embodiments, the lipid composition comprises compound 18, MSPC and DOTAP.

In one embodiment, the lipid composition comprises about 50 mol % of a compound of formula (I), about 10 mol % of DSPC or MSPC, about 33.5 mol % of cholesterol, about 1.5 mol % of PEG-DMG, and about 5 mol % of DOTAP. In one embodiment, the lipid composition comprises about 50 mol % of a compound of formula (I), about 10 mol % of DSPC or MSPC, about 28.5 mol % of cholesterol, about 1.5 mol % of PEG-DMG, and about 10 mol % of DOTAP.

The components of the lipid nanoparticle may be tailored for optimal delivery of the polynucleotides based on the desired outcome. As a non-limiting example, the lipid nanoparticle may comprise 40-60 mol % an ionizable amino lipid (e.g., a compound of formula (I), 8-16 mol % phospholipid, 30-45 mol % cholesterol, 1-5 mol % PEG lipid, and optionally 1-15 mol % quaternary amine compound.

In some embodiments, the lipid nanoparticle may comprise 45-65 mol % of an ionizable amino lipid (e.g., a compound of formula (I)), 5-10 mol % phospholipid, 25-40 mol % cholesterol, 0.5-5 mol % PEG lipid, and optionally 1-15 mol % quaternary amine compound. Non-limiting examples of nucleic acid lipid particles are disclosed in U.S. Patent Publication No. 20140121263, herein incorporated by reference in its entirety.

(v) Other Ionizable Amino Lipids

The lipid composition of the pharmaceutical composition disclosed herein can comprise one or more ionizable amino lipids in addition to a lipid according to formula (I).

Ionizable lipids may be selected from the non-limiting group consisting of
3-(didodecylamino)-N1,N1,4-tridodecyl-1-piperazineethanamine (KL10),
N1-[2-(didodecylamino)ethyl]-N1,N4,N4-tridodecyl-1,4-piperazinediethanamine (KL22),
14,25-ditridecyl-15,18,21,24-tetraaza-octatriacontane (KL25),
1,2-dilinoleyloxy-N,N-dimethylaminopropane (DLin-DMA),
2,2-dilinoleyl-4-dimethylaminomethyl-[1,3]-dioxolane (DLin-K-DMA),
heptatriaconta-6,9,28,31-tetraen-19-yl 4-(dimethylamino)butanoate (DLin-MC3-DMA),
2,2-dilinoleyl-4-(2-dimethylaminoethyl)-[1,3]-dioxolane (DLin-KC2-DMA),
1,2-dioleyloxy-N,N-dimethylaminopropane (DODMA),
(13Z,16Z)—N,N-dimethyl-3-nonydocosa-13-16-dien-1-amine (L608),
2-({8-[(3β)-cholest-5-en-3-yloxy]octyl}oxy)-N,N-dimethyl-3-[(9Z,12Z)-octadeca-9,12-dien-1-yloxy]propan-1-amine (Octyl-CLinDMA),
(2R)-2-({8-[(3β)-cholest-5-en-3-yloxy]octyl}oxy)-N,N-dimethyl-3-[(9Z,12Z)-octadeca-9,12-dien-1-yloxy]propan-1-amine (Octyl-CLinDMA (2R)), and
(2S)-2-({8-[(3β)-cholest-5-en-3-yloxy]octyl}oxy)-N,N-dimethyl-3-[(9Z,12Z)-octadeca-9,12-dien-1-yloxy]propan-1-amine (Octyl-CLinDMA (2S)). In addition to these, an ionizable amino lipid may also be a lipid including a cyclic amine group.

Ionizable lipids can also be the compounds disclosed in International Publication No. WO 2015/199952 A1, hereby incorporated by reference in its entirety.

(vi) Other Lipid Composition Components

The lipid composition of a pharmaceutical composition disclosed herein may include one or more components in addition to those described above. For example, the lipid composition may include one or more permeability enhancer molecules, carbohydrates, polymers, surface altering agents (e.g., surfactants), or other components. For example, a permeability enhancer molecule may be a molecule described by U.S. Patent Application Publication No. 2005/0222064. Carbohydrates may include simple sugars (e.g., glucose) and polysaccharides (e.g., glycogen and derivatives and analogs thereof). The lipid composition may include a buffer such as, but not limited to, citrate or phosphate at a pH of 7, salt and/or sugar. Salt and/or sugar may be included in the formulations described herein for isotonicity.

A polymer may be included in and/or used to encapsulate or partially encapsulate a pharmaceutical composition disclosed herein (e.g., a pharmaceutical composition in lipid nanoparticle form). A polymer may be biodegradable and/or biocompatible. A polymer may be selected from, but is not limited to, polyamines, polyethers, polyamides, polyesters, polycarbamates, polyureas, polycarbonates, polystyrenes, polyimides, polysulfones, polyurethanes, polyacetylenes, polyethylenes, polyethyleneimines, polyisocyanates, polyacrylates, polymethacrylates, polyacrylonitriles, and polyarylates.

The ratio between the lipid composition and the polynucleotide range can be from about 10:1 to about 60:1 (wt/wt).

In some embodiments, the ratio between the lipid composition and the polynucleotide can be about 10:1, 11:1, 12:1, 13:1, 14:1, 15:1, 16:1, 17:1, 18:1, 19:1, 20:1, 21:1, 22:1, 23:1, 24:1, 25:1, 26:1, 27:1, 28:1, 29:1, 30:1, 31:1, 32:1, 33:1, 34:1, 35:1, 36:1, 37:1, 38:1, 39:1, 40:1, 41:1, 42:1, 43:1, 44:1, 45:1, 46:1, 47:1, 48:1, 49:1, 50:1, 51:1, 52:1, 53:1, 54:1, 55:1, 56:1, 57:1, 58:1, 59:1 or 60:1 (wt/wt). In some embodiments, the wt/wt ratio of the lipid composition to the polynucleotide encoding a therapeutic agent is about 20:1 or about 15:1.

In some embodiments, the pharmaceutical composition disclosed herein can contain more than one polypeptides. For example, a pharmaceutical composition disclosed herein can contain two or more polynucleotides (e.g., RNA, e.g., mRNA).

In one embodiment, the lipid nanoparticles described herein may comprise polynucleotides (e.g., mRNA) in a lipid:polynucleotide weight ratio of 5:1, 10:1, 15:1, 20:1, 25:1, 30:1, 35:1, 40:1, 45:1, 50:1, 55:1, 60:1 or 70:1, or a range or any of these ratios such as, but not limited to, 5:1 to about 10:1, from about 5:1 to about 15:1, from about 5:1 to about 20:1, from about 5:1 to about 25:1, from about 5:1 to about 30:1, from about 5:1 to about 35:1, from about 5:1 to about 40:1, from about 5:1 to about 45:1, from about 5:1 to about 50:1, from about 5:1 to about 55:1, from about 5:1 to about 60:1, from about 5:1 to about 70:1, from about 10:1 to about 15:1, from about 10:1 to about 20:1, from about 10:1 to about 25:1, from about 10:1 to about 30:1, from about 10:1 to about 35:1, from about 10:1 to about 40:1, from about 10:1 to about 45:1, from about 10:1 to about 50:1, from about 10:1 to about 55:1, from about 10:1 to about 60:1, from about 10:1 to about 70:1, from about 15:1 to about 20:1, from about 15:1 to about 25:1, from about 15:1 to about 30:1, from about 15:1 to about 35:1, from about 15:1 to about 40:1, from about 15:1 to about 45:1, from about 15:1 to about 50:1, from about 15:1 to about 55:1, from about 15:1 to about 60:1 or from about 15:1 to about 70:1. In one embodiment, the lipid nanoparticles described herein may comprise the polynucleotide in a concentration from approximately 0.1 mg/ml to 2 mg/ml such as, but not limited to, 0.1 mg/ml, 0.2 mg/ml, 0.3 mg/ml, 0.4 mg/ml, 0.5 mg/ml, 0.6 mg/ml, 0.7 mg/ml, 0.8 mg/ml, 0.9 mg/ml, 1.0 mg/ml, 1.1 mg/ml, 1.2 mg/ml, 1.3 mg/ml, 1.4 mg/ml, 1.5 mg/ml, 1.6 mg/ml, 1.7 mg/ml, 1.8 mg/ml, 1.9 mg/ml, 2.0 mg/ml or greater than 2.0 mg/ml.

In one embodiment, formulations comprising the polynucleotides and lipid nanoparticles described herein may comprise 0.15 mg/ml to 2 mg/ml of the polynucleotide described herein (e.g., mRNA). In some embodiments, the formulation may further comprise 10 mM of citrate buffer and the formulation may additionally comprise up to 10% w/w of sucrose (e.g., at least 1% w/w, at least 2% w/w/, at least 3% w/w, at least 4% w/w, at least 5% w/w, at least 6% w/w, at least 7% w/w, at least 8% w/w, at least 9% w/w or 10% w/w).

(vii) Nanoparticle Compositions

In some embodiments, the pharmaceutical compositions disclosed herein are formulated as lipid nanoparticles (LNP). Accordingly, the present disclosure also provides nanoparticle compositions comprising (i) a lipid composition comprising a delivery agent such as a compound of formula (I) as described herein, and (ii) a polynucleotide of the disclosure. In such nanoparticle composition, the lipid composition disclosed herein can encapsulate the polynucleotide of the disclosure.

Nanoparticle compositions are typically sized on the order of micrometers or smaller and may include a lipid bilayer. Nanoparticle compositions encompass lipid nanoparticles (LNPs), liposomes (e.g., lipid vesicles), and lipoplexes. For example, a nanoparticle composition may be a liposome having a lipid bilayer with a diameter of 500 nm or less.

Nanoparticle compositions include, for example, lipid nanoparticles (LNPs), liposomes, and lipoplexes. In some embodiments, nanoparticle compositions are vesicles including one or more lipid bilayers. In certain embodiments, a nanoparticle composition includes two or more concentric bilayers separated by aqueous compartments. Lipid bilayers may be functionalized and/or crosslinked to one another. Lipid bilayers may include one or more ligands, proteins, or channels.

Nanoparticle compositions of the present disclosure comprise at least one compound according to formula (I). Nanoparticle compositions can also include a variety of other components. For example, the nanoparticle composition may include one or more other lipids in addition to a lipid according to formula (I), such as (i) at least one phospholipid, (ii) at least one quaternary amine compound, (iii) at least one structural lipid, (iv) at least one PEG-lipid, or (v) any combination thereof.

In some embodiments, the nanoparticle composition comprises a compound of formula (I) and a phospholipid (e.g., DSPC or MSPC). In some embodiments, the nanoparticle composition comprises a compound of formula (I), a phospholipid (e.g., DSPC or MSPC), and a quaternary amine compound (e.g., DOTAP). In some embodiments, the nanoparticle composition comprises a compound of formula (I), and a quaternary amine compound (e.g., DOTAP).

In one embodiment, the nanoparticle composition comprises (1) a lipid composition comprising about 50 mole % of a compound of formula (I); about 10 mole % of DSPC or MSPC; about 33.5 mole % of cholesterol; about 1.5 mole % of PEG-DMG (e.g., PEG2k-DMG); about 5 mole % of DOTAP; and (2) a polynucleotide.

In one embodiment, the nanoparticle composition comprises (1) a lipid composition comprising about 50 mole % of a compound of formula (I); about 10 mole % of DSPC or MSPC; about 28.5 mole % of cholesterol; about 1.5 mole % of PEG-DMG (e.g., PEG2k-DMG); about 10 mole % of DOTAP; and (2) a polynucleotide.

In one embodiment, the nanoparticle composition comprises (1) a lipid composition comprising about 50 mole % of a compound of formula (I); about 10 mole % of DSPC or MSPC; about 23.5 mole % of cholesterol; about 1.5 mole % of PEG-DMG (e.g., PEG2k-DMG); about 15 mole % of DOTAP; and (2) a polynucleotide.

Nanoparticle compositions may be characterized by a variety of methods. For example, microscopy (e.g., transmission electron microscopy or scanning electron microscopy) may be used to examine the morphology and size distribution of a nanoparticle composition. Dynamic light scattering or potentiometry (e.g., potentiometric titrations) may be used to measure zeta potentials. Dynamic light scattering may also be utilized to determine particle sizes. Instruments such as the Zetasizer Nano ZS (Malvern Instruments Ltd, Malvern, Worcestershire, UK) may also be used to measure multiple characteristics of a nanoparticle composition, such as particle size, polydispersity index, and zeta potential.

The size of the nanoparticles can help counter biological reactions such as, but not limited to, inflammation, or can increase the biological effect of the polynucleotide.

As used herein, "size" or "mean size" in the context of nanoparticle compositions refers to the mean diameter of a nanoparticle composition.

In one embodiment, the polynucleotides of the disclosure are formulated in lipid nanoparticles having a diameter from about 10 to about 100 nm such as, but not limited to, about 10 to about 20 nm, about 10 to about 30 nm, about 10 to about 40 nm, about 10 to about 50 nm, about 10 to about 60 nm, about 10 to about 70 nm, about 10 to about 80 nm, about 10 to about 90 nm, about 20 to about 30 nm, about 20 to about 40 nm, about 20 to about 50 nm, about 20 to about 60 nm, about 20 to about 70 nm, about 20 to about 80 nm, about 20 to about 90 nm, about 20 to about 100 nm, about 30 to about 40 nm, about 30 to about 50 nm, about 30 to about 60 nm, about 30 to about 70 nm, about 30 to about 80 nm, about 30 to about 90 nm, about 30 to about 100 nm, about 40 to about 50 nm, about 40 to about 60 nm, about 40 to about 70 nm, about 40 to about 80 nm, about 40 to about 90 nm, about 40 to about 100 nm, about 50 to about 60 nm, about 50 to about 70 nm, about 50 to about 80 nm, about 50 to about 90 nm, about 50 to about 100 nm, about 60 to about 70 nm, about 60 to about 80 nm, about 60 to about 90 nm, about 60 to about 100 nm, about 70 to about 80 nm, about 70 to about 90 nm, about 70 to about 100 nm, about 80 to about 90 nm, about 80 to about 100 nm and/or about 90 to about 100 nm.

In one embodiment, the nanoparticles have a diameter from about 10 to 500 nm. In one embodiment, the nanoparticle has a diameter greater than 100 nm, greater than 150 nm, greater than 200 nm, greater than 250 nm, greater than 300 nm, greater than 350 nm, greater than 400 nm, greater than 450 nm, greater than 500 nm, greater than 550 nm, greater than 600 nm, greater than 650 nm, greater than 700 nm, greater than 750 nm, greater than 800 nm, greater than 850 nm, greater than 900 nm, greater than 950 nm or greater than 1000 nm.

In some embodiments, the largest dimension of a nanoparticle composition is 1 μm or shorter (e.g., 1 μm, 900 nm, 800 nm, 700 nm, 600 nm, 500 nm, 400 nm, 300 nm, 200 nm, 175 nm, 150 nm, 125 nm, 100 nm, 75 nm, 50 nm, or shorter).

A nanoparticle composition may be relatively homogenous. A polydispersity index may be used to indicate the homogeneity of a nanoparticle composition, e.g., the particle size distribution of the nanoparticle composition. A small (e.g., less than 0.3) polydispersity index generally indicates a narrow particle size distribution. A nanoparticle composition may have a polydispersity index from about 0 to about 0.25, such as 0.01, 0.02, 0.03, 0.04, 0.05, 0.06, 0.07, 0.08, 0.09, 0.10, 0.11, 0.12, 0.13, 0.14, 0.15, 0.16, 0.17, 0.18, 0.19, 0.20, 0.21, 0.22, 0.23, 0.24, or 0.25. In some embodiments, the polydispersity index of a nanoparticle composition disclosed herein may be from about 0.10 to about 0.20.

The zeta potential of a nanoparticle composition may be used to indicate the electrokinetic potential of the composition. For example, the zeta potential may describe the surface charge of a nanoparticle composition. Nanoparticle compositions with relatively low charges, positive or negative, are generally desirable, as more highly charged species may interact undesirably with cells, tissues, and other elements in the body. In some embodiments, the zeta potential of a nanoparticle composition disclosed herein may be from about −10 mV to about +20 mV, from about −10 mV to about +15 mV, from about 10 mV to about +10 mV, from about −10 mV to about +5 mV, from about −10 mV to about 0 mV, from about −10 mV to about −5 mV, from about −5 mV to about +20 mV, from about −5 mV to about +15 mV, from about −5 mV to about +10 mV, from about −5 mV to about +5 mV, from about −5 mV to about 0 mV, from about 0 mV to about +20 mV, from about 0 mV to about +15 mV, from about 0 mV to about +10 mV, from about 0 mV to about +5 mV, from about +5 mV to about +20 mV, from about +5 mV to about +15 mV, or from about +5 mV to about +10 mV. In some embodiments, the zeta potential of the lipid nanoparticles may be from about 0 mV to about 100 mV, from about 0 mV to about 90 mV, from about 0 mV to about 80 mV, from about 0 mV to about 70 mV, from about 0 mV to about 60 mV, from about 0 mV to about 50 mV, from about 0 mV to about 40 mV, from about 0 mV to about 30 mV, from about 0 mV to about 20 mV, from about 0 mV to about 10 mV, from about 10 mV to about 100 mV, from about 10 mV to about 90 mV, from about 10 mV to about 80 mV, from about 10 mV to about 70 mV, from about 10 mV to about 60 mV, from about 10 mV to about 50 mV, from about 10 mV to about 40 mV, from about 10 mV to about 30 mV, from about 10 mV to about 20 mV, from about 20 mV to about 100 mV, from about 20 mV to about 90 mV, from about 20 mV to about 80 mV, from about 20 mV to about 70 mV, from about 20 mV to about 60 mV, from about 20 mV to about 50 mV, from about 20 mV to about 40 mV, from about 20 mV to about 30 mV, from about 30 mV to about 100 mV, from about 30 mV to about 90 mV, from about 30 mV to about 80 mV, from about 30 mV to about 70 mV, from about 30 mV to about 60 mV, from about 30 mV to about 50 mV, from about 30 mV to about 40 mV, from about 40 mV to about 100 mV, from about 40 mV to about 90 mV, from about 40 mV to about 80 mV, from about 40 mV to about 70 mV, from about 40 mV to about 60 mV, and from about 40 mV to about 50 mV. In some embodiments, the zeta potential of the lipid nanoparticles may be from about 10 mV to about 50 mV, from about 15 mV to about 45 mV, from about 20 mV to about 40 mV, and from about 25 mV to about 35 mV. In some embodiments, the zeta potential of the lipid nanoparticles may be about 10 mV, about 20 mV, about 30 mV, about 40 mV, about 50 mV, about 60 mV, about 70 mV, about 80 mV, about 90 mV, and about 100 mV.

The term "encapsulation efficiency" of a polynucleotide describes the amount of the polynucleotide that is encapsulated by or otherwise associated with a nanoparticle composition after preparation, relative to the initial amount provided. As used herein, "encapsulation" may refer to complete, substantial, or partial enclosure, confinement, surrounding, or encasement.

Encapsulation efficiency is desirably high (e.g., close to 100%). The encapsulation efficiency may be measured, for example, by comparing the amount of the polynucleotide in a solution containing the nanoparticle composition before and after breaking up the nanoparticle composition with one or more organic solvents or detergents.

Fluorescence may be used to measure the amount of free polynucleotide in a solution. For the nanoparticle compositions described herein, the encapsulation efficiency of a polynucleotide may be at least 50%, for example 50%, 55%, 60%, 65%, 70%, 75%, 80%, 85%, 90%, 91%, 92%, 93%, 94%, 95%, 96%, 97%, 98%, 99%, or 100%. In some embodiments, the encapsulation efficiency may be at least 80%. In certain embodiments, the encapsulation efficiency may be at least 90%. The amount of a polynucleotide present in a pharmaceutical composition disclosed herein can depend on multiple factors such as the size of the polynucleotide, desired target and/or application, or other properties of the nanoparticle composition as well as on the properties of the polynucleotide.

For example, the amount of an mRNA useful in a nanoparticle composition may depend on the size (expressed as length, or molecular mass), sequence, and other characteristics of the mRNA. The relative amounts of a polynucleotide in a nanoparticle composition may also vary.

The relative amounts of the lipid composition and the polynucleotide present in a lipid nanoparticle composition of the present disclosure can be optimized according to considerations of efficacy and tolerability. For compositions including an mRNA as a polynucleotide, the N:P ratio can serve as a useful metric.

As the N:P ratio of a nanoparticle composition controls both expression and tolerability, nanoparticle compositions with low N:P ratios and strong expression are desirable. N:P ratios vary according to the ratio of lipids to RNA in a nanoparticle composition.

In general, a lower N:P ratio is preferred. The one or more RNA, lipids, and amounts thereof may be selected to provide an N:P ratio from about 2:1 to about 30:1, such as 2:1, 3:1, 4:1, 5:1, 6:1, 7:1, 8:1, 9:1, 10:1, 12:1, 14:1, 16:1, 18:1, 20:1, 22:1, 24:1, 26:1, 28:1, or 30:1. In certain embodiments, the N:P ratio may be from about 2:1 to about 8:1. In other embodiments, the N:P ratio is from about 5:1 to about 8:1. In certain embodiments, the N:P ratio is between 5:1 and 6:1. In one specific aspect, the N:P ratio is about is about 5.67:1.

In addition to providing nanoparticle compositions, the present disclosure also provides methods of producing lipid nanoparticles comprising encapsulating a polynucleotide. Such method comprises using any of the pharmaceutical compositions disclosed herein and producing lipid nanoparticles in accordance with methods of production of lipid nanoparticles known in the art. See, e.g., Wang et al. (2015) "Delivery of oligonucleotides with lipid nanoparticles" Adv. Drug Deliv. Rev. 87:68-80; Silva et al. (2015) "Delivery Systems for Biopharmaceuticals. Part I: Nanoparticles and Microparticles" Curr. Pharm. Technol. 16: 940-954; Naseri et al. (2015) "Solid Lipid Nanoparticles and Nanostructured Lipid Carriers: Structure, Preparation and Application" Adv. Pharm. Bull. 5:305-13; Silva et al. (2015) "Lipid nanoparticles for the delivery of biopharmaceuticals" Curr. Pharm. Biotechnol. 16:291-302, and references cited therein.

26. Other Delivery Agents a. Liposomes, Lipoplexes, and Lipid Nanoparticles

In some embodiments, the compositions or formulations of the present disclosure comprise a delivery agent, e.g., a liposome, a lioplexes, a lipid nanoparticle, or any combination thereof. The polynucleotides described herein can be formulated using one or more liposomes, lipoplexes, or lipid nanoparticles. Liposomes, lipoplexes, or lipid nanoparticles can be used to improve the efficacy of the polynucleotides directed protein production as these formulations can increase cell transfection by the polynucleotide; and/or increase the translation of encoded protein. The liposomes, lipoplexes, or lipid nanoparticles can also be used to increase the stability of the polynucleotides.

Liposomes are artificially-prepared vesicles that may primarily be composed of a lipid bilayer and may be used as a delivery vehicle for the administration of pharmaceutical formulations. Liposomes can be of different sizes. A multilamellar vesicle (MLV) may be hundreds of nanometers in diameter, and may contain a series of concentric bilayers separated by narrow aqueous compartments. A small unicellular vesicle (SUV) may be smaller than 50 nm in diameter, and a large unilamellar vesicle (LUV) may be between 50 and 500 nm in diameter. Liposome design may include, but is not limited to, opsonins or ligands to improve the attachment of liposomes to unhealthy tissue or to activate events such as, but not limited to, endocytosis. Liposomes may contain a low or a high pH value in order to improve the delivery of the pharmaceutical formulations.

The formation of liposomes may depend on the pharmaceutical formulation entrapped and the liposomal ingredients, the nature of the medium in which the lipid vesicles are dispersed, the effective concentration of the entrapped substance and its potential toxicity, any additional processes involved during the application and/or delivery of the vesicles, the optimal size, polydispersity and the shelf-life of the vesicles for the intended application, and the batch-to-batch reproducibility and scale up production of safe and efficient liposomal products, etc.

As a non-limiting example, liposomes such as synthetic membrane vesicles may be prepared by the methods, apparatus and devices described in U.S. Pub. Nos. US20130177638, US20130177637, US20130177636, US20130177635, US20130177634, US20130177633, US20130183375, US20130183373, and US20130183372. In some embodiments, the polynucleotides described herein may be encapsulated by the liposome and/or it may be contained in an aqueous core that may then be encapsulated by the liposome as described in, e.g., Intl. Pub. Nos. WO2012031046, WO2012031043, WO2012030901, WO2012006378, and WO2013086526; and U.S. Pub. Nos. US20130189351, US20130195969 and US20130202684. Each of the references in herein incorporated by reference in its entirety.

In some embodiments, the polynucleotides described herein can be formulated in a cationic oil-in-water emulsion where the emulsion particle comprises an oil core and a cationic lipid that can interact with the polynucleotide anchoring the molecule to the emulsion particle. In some embodiments, the polynucleotides described herein can be formulated in a water-in-oil emulsion comprising a continuous hydrophobic phase in which the hydrophilic phase is dispersed. Exemplary emulsions can be made by the methods described in Intl. Pub. Nos. WO2012006380 and WO201087791, each of which is herein incorporated by reference in its entirety.

In some embodiments, the polynucleotides described herein can be formulated in a lipid-polycation complex. The formation of the lipid-polycation complex can be accomplished by methods as described in, e.g., U.S. Pub. No. US20120178702. As a non-limiting example, the polycation can include a cationic peptide or a polypeptide such as, but not limited to, polylysine, polyornithine and/or polyarginine and the cationic peptides described in Intl. Pub. No.

WO2012013326 or U.S. Pub. No. US20130142818. Each of the references is herein incorporated by reference in its entirety.

In some embodiments, the polynucleotides described herein can be formulated in a lipid nanoparticle (LNP) such as those described in Intl. Pub. Nos. WO2013123523, WO2012170930, WO2011127255 and WO2008103276; and U.S. Pub. No. US20130171646, each of which is herein incorporated by reference in its entirety.

Lipid nanoparticle formulations typically comprise one or more lipids. In some embodiments, the lipid is a cationic or an ionizable lipid. In some embodiments, lipid nanoparticle formulations further comprise other components, including a phospholipid, a structural lipid, a quaternary amine compound, and a molecule capable of reducing particle aggregation, for example a PEG or PEG-modified lipid.

Cationic and ionizable lipids may include those as described in, e.g., Intl. Pub. Nos. WO2015199952, WO 2015130584, WO 2015011633, and WO2012040184 WO2013126803, WO2011153120, WO2011149733, WO2011090965, WO2011043913, WO2011022460, WO2012061259, WO2012054365, WO2012044638, WO2010080724, WO201021865, WO2008103276, and WO2013086373; U.S. Pat. Nos. 7,893,302, 7,404,969, 8,283,333, and 8,466,122; and U.S. Pub. Nos. US20110224447, US20120295832, US20150315112, US20100036115, US20120202871, US20130064894, US20130129785, US20130150625, US20130178541, US20130123338 and US20130225836, each of which is herein incorporated by reference in its entirety. In some embodiments, the amount of the cationic and ionizable lipids in the lipid composition ranges from about 0.01 mol % to about 99 mol %.

Exemplary ionizable lipids include, but not limited to, any one of Compounds 1-147 disclosed herein, DLin-MC3-DMA (MC3), DLin-DMA, DLenDMA, DLin-D-DMA, DLin-K-DMA, DLin-M-C2-DMA, DLin-K-DMA, DLin-KC2-DMA, DLin-KC3-DMA, DLin-KC4-DMA, DLin-C2K-DMA, DLin-MP-DMA, DODMA, 98N12-5, C12-200, DLin-C-DAP, DLin-DAC, DLinDAP, DLinAP, DLin-EG-DMA, DLin-2-DMAP, KL10, KL22, KL25, Octyl-CLinDMA, Octyl-CLinDMA (2R), Octyl-CLinDMA (2S), and any combination thereof. Other exemplary ionizable lipids include, (13Z,16Z)—N,N-dimethyl-3-nonyldocosa-13,16-dien-1-amine (L608), (20Z,23Z)—N,N-dimethyl-nonacosa-20,23-dien-10-amine, (17Z,20Z)—N,N-dimemyl-hexacosa-17,20-dien-9-amine, (16Z,19Z)—N5N-dimethylpentacosa-16,19-dien-8-amine, (13Z,16Z)—N,N-dimethyldocosa-13,16-dien-5-amine, (12Z,15Z)—N,N-dimethylhenicosa-12,15-dien-4-amine, (14Z,17Z)—N,N-dimethyltricosa-14,17-dien-6-amine, (15Z,18Z)—N,N-dimethyltetracosa-15,18-dien-7-amine, (18Z,21Z)—N,N-dimethylheptacosa-18,21-dien-10-amine, (15Z,18Z)—N,N-dimethyltetracosa-15,18-dien-5-amine, (14Z,17Z)—N,N-dimethyltricosa-14,17-dien-4-amine, (19Z,22Z)—N,N-dimeihyloctacosa-19,22-dien-9-amine, (18Z,21Z)—N,N-dimethylheptacosa-18,21-dien-8-amine, (17Z,20Z)—N,N-dimethylhexacosa-17,20-dien-7-amine, (16Z,19Z)—N,N-dimethylpentacosa-16,19-dien-6-amine, (22Z,25Z)—N,N-dimethylhentriaconta-22,25-dien-10-amine, (21Z,24Z)—N,N-dimethyltriaconta-21,24-dien-9-amine, (18Z)—N,N-dimetylheptacos-18-en-10-amine, (17Z)—N,N-dimethylhexacos-17-en-9-amine, (19Z,22Z)—N,N-dimethyloctacosa-19,22-dien-7-amine, N,N-dimethylheptacosan-10-amine, (20Z,23Z)—N-ethyl-N-methylnonacos-20,23-dien-10-amine, 1-[(11Z,14Z)-1-nonylicosa-11,14-dien-1-yl]pyrrolidine, (20Z)—N,N-dimethylheptacos-20-en-10-amine, (15Z)—N,N-dimethyl eptacos-15-en-10-amine, (14Z)—N,N-dimethylnonacos-14-en-10-amine, (17Z)—N,N-dimethylnonacos-17-en-10-amine, (24Z)—N,N-dimethyltritriacont-24-en-10-amine, (20Z)—N,N-dimethylnonacos-20-en-10-amine, (22Z)—N,N-dimethylhentriacont-22-en-10-amine, (16Z)—N,N-dimethylpentacos-16-en-8-amine, (12Z,15Z)—N,N-dimethyl-2-nonylhenicosa-12,15-dien-1-amine, N,N-dimethyl-1-R1S,2R)-2-octylcyclopropyl]eptadecan-8-amine, 1-[(1S,2R)-2-hexylcyclopropyl]-N,N-dimethylnonadecan-10-amine, N,N-dimethyl-1-[(1S,2R)-2-octylcyclopropyl]nonadecan-10-amine, N,N-dimethyl-21-[(1S,2R)-2-octylcyclopropyl]henicosan-10-amine, N,N-dimethyl-1-R1S,2S)-2-{[(1R,2R)-2-pentylcyclopropyl]methyl}cyclopropyl]nonadecan-10-amine, N,N-dimethyl-1-[(1S,2R)-2-octylcyclopropyl]hexadecan-8-amine, N,N-dimethyl-[(1R,2S)-2-undecylcyclopropyl]tetradecan-5-amine, N,N-dimethyl-3-{7-[(1S,2R)-2-octylcyclopropyl]heptyl}dodecan-1-amine, 1-[(1R,2S)-2-heptylcyclopropyl]-N,N-dimethyloctadecan-9-amine, 1-[(1S,2R)-2-decylcyclopropyl]-N,N-dimethylpentadecan-6-amine, N,N-dimethyl-1-[(1S,2R)-2-octylcyclopropyl]pentadecan-8-amine, R—N,N-dimethyl-1-[(9Z,12Z)-octadeca-9,12-dien-1-yloxy]-3-(octyloxy)propan-2-amine, S—N,N-dimethyl-1-[(9Z,12Z)-octadeca-9,12-dien-1-yloxy]-3-(octyloxy) propan-2-amine, 1-{2-[(9Z,12Z)-octadeca-9,12-dien-1-yloxy]-1-[(octyloxy)methyl]ethyl}pyrrolidine, (2S)—N,N-dimethyl-1-[(9Z,12Z)-octadeca-9,12-dien-1-yloxy]-3-[(5Z)-oct-5-en-1-yloxy]propan-2-amine, 1-{2-[(9Z,12Z)-octadeca-9,12-dien-1-yloxy]-1}-[(octyloxy)methyl]ethyl}azetidine, (2S)-1-(hexyloxy)-N,N-dimethyl-3-[(9Z,12Z)-octadeca-9,12-dien-1-yloxy]propan-2-amine, (2S)-1-(heptyloxy)-N,N-dimethyl-3-[(9Z,12Z)-octadeca-9,12-dien-1-yloxy]propan-2-amine, N,N-dimethyl-1-(nonyloxy)-3-[(9Z,12Z)-octadeca-9,12-dien-1-yloxy]propan-2-amine, N,N-dimethyl-1-[(9Z)-octadec-9-en-1-yloxy]-3-(octyloxy) propan-2-amine; (2S)—N,N-dimethyl-1-[(6Z,9Z,12Z)-octadeca-6,9,12-trien-1-yloxy]-3-(octyloxy)propan-2-amine, (2S)-1-[(11Z,14Z)-icosa-11,14-dien-1-yloxy]-N,N-dimethyl-3-(pentyloxy)propan-2-amine, (2S)-1-(hexyloxy)-3-[(11Z,14Z)-icosa-11,14-dien-1-yloxy]-N,N-dimethylpropan-2-amine, 1-[(11Z,14Z)-icosa-11,14-dien-1-yloxy]-N,N-dimethyl-3-(octyloxy)propan-2-amine, 1-[(13Z,16Z)-docosa-13,16-dien-1-yloxy]-N,N-dimethyl-3-(octyloxy) propan-2-amine, (2S)-1-[(13Z,16Z)-docosa-13,16-dien-1-yloxy]-3-(hexyloxy)-N,N-dimethylpropan-2-amine, (2S)-1-[(13Z)-docos-13-en-1-yloxy]-3-(hexyloxy)-N,N-dimethylpropan-2-amine, 1-[(13Z)-docos-13-en-1-yloxy]-N,N-dimethyl-3-(octyloxy)propan-2-amine, 1-[(9Z)-hexadec-9-en-1-yloxy]-N,N-dimethyl-3-(octyloxy)propan-2-amine, (2R)—N,N-dimethyl-H(1-metoyloctyl)oxy]-3-[(9Z,12Z)-octadeca-9,12-dien-1-yloxy]propan-2-amine, (2R)-1-[(3,7-dimethyloctyl)oxy]-N,N-dimethyl-3-[(9Z,12Z)-octadeca-9,12-dien-1-yloxy]propan-2-amine, N,N-dimethyl-1-(octyloxy)-3-({8-[(1S,2S)-2-{[(1R,2R)-2-pentylcyclopropyl]methyl}cyclopropyl]octyl}oxy)propan-2-amine, N,N-dimethyl-1-{[8-(2-oclylcyclopropyl)octyl]oxy}-3-(octyloxy)propan-2-amine, and (11E,20Z,23Z)—N,N-dimethylnonacosa-11,20,2-trien-10-amine, and any combination thereof.

Phospholipids include, but are not limited to, glycerophospholipids such as phosphatidylcholines, phosphatidylethanolamines, phosphatidylserines, phosphatidylinositols, phosphatidy glycerols, and phosphatidic acids. Phospholipids also include phosphosphingolipid, such as sphingomyelin. In some embodiments, the phospholipids are DLPC, DMPC, DOPC, DPPC, DSPC, DUPC, 18:0 Diether PC, DLnPC, DAPC, DHAPC, DOPE, 4ME 16:0 PE, DSPE, DLPE, DLnPE, DAPE, DHAPE, DOPG, and any combination thereof. In some embodiments, the phospholipids are MPPC, MSPC, PMPC, PSPC, SMPC, SPPC, DHAPE, DOPG, and any combination thereof. In some embodiments, the amount of phospholipids (e.g., DSPC and/or MSPC) in the lipid composition ranges from about 1 mol % to about 20 mol %.

The structural lipids include sterols and lipids containing sterol moieties. In some embodiments, the structural lipids include cholesterol, fecosterol, sitosterol, ergosterol, campesterol, stigmasterol, brassicasterol, tomatidine, tomatine, ursolic acid, alpha-tocopherol, and mixtures thereof. In some embodiments, the structural lipid is cholesterol. In some embodiments, the amount of the structural lipids (e.g., cholesterol) in the lipid composition ranges from about 20 mol % to about 60 mol %.

The quaternary amine compound as described herein include 1,2-dioleoyl-3-trimethylammonium-propane (DOTAP), N-[1-(2,3-dioleoyloxy)propyl]-N,N,N-trimethylammonium chloride (DOTMA), 1-[2-(oleoyloxy)ethyl]-2-oleyl-3-(2-hydroxyethyl)imidazolinium chloride (DOTIM), 2,3-dioleyloxy-N-[2(sperminecarboxamido)ethyl]-N,N-dimethyl-1-propanaminium trifluoroacetate (DOSPA), N,N-distearyl-N,N-dimethylammonium bromide (DDAB), N-(1, 2-dimyristyloxyprop-3-yl)-N,N-dimethyl-N-hydroxyethyl ammonium bromide (DMRIE), N-(1,2-dioleoyloxyprop-3-yl)-N,N-dimethyl-N-hydroxyethyl ammonium bromide (DORIE), N,N-dioleyl-N,N-dimethylammonium chloride (DODAC), 1,2-dilauroyl-sn-glycero-3-ethylphosphocholine (DLePC), 1,2-distearoyl-3-trimethylammonium-propane (DSTAP), 1,2-dipalmitoyl-3-trimethylammonium-propane (DPTAP), 1,2-dilinoleoyl-3-trimethylammonium-propane (DLTAP), 1,2-dimyristoyl-3-trimethylammonium-propane (DMTAP), 1,2-distearoyl-sn-glycero-3-ethylphosphocholine (DSePC), 1,2-dipalmitoyl-sn-glycero-3-ethylphosphocholine (DPePC), 1,2-dimyristoyl-sn-glycero-3-ethylphosphocholine (DMePC), 1,2-dioleoyl-sn-glycero-3-ethylphosphocholine (DOePC), 1,2-di-(9Z-tetradecenoyl)-sn-glycero-3-ethylphosphocholine (14:1 EPC), 1-palmitoyl-2-oleoyl-sn-glycero-3-ethylphosphocholine (16:0-18:1 EPC), and any combination thereof. In some embodiments, the amount of the quaternary amine compounds (e.g., DOTAP) in the lipid composition ranges from about 0.01 mol % to about 20 mol %.

The PEG-modified lipids include PEG-modified phosphatidylethanolamine and phosphatidic acid, PEG-ceramide conjugates (e.g., PEG-CerC14 or PEG-CerC20), PEG-modified dialkylamines and PEG-modified 1,2-diacyloxypropan-3-amines. Such lipids are also referred to as PEGylated lipids. For example, a PEG lipid may be PEG-c-DOMG, PEG-DMG, PEG-DLPE, PEG DMPE, PEG-DPPC, or a PEG-DSPE lipid. In some embodiments, the PEG-lipid are 1,2-dimyristoyl-sn-glycerol methoxypolyethylene glycol (PEG-DMG), 1,2-distearoyl-sn-glycero-3-phosphoethanolamine-N-[amino(polyethylene glycol)] (PEG-DSPE), PEG-disteryl glycerol (PEG-DSG), PEG-dipalmetoleyl, PEG-dioleyl, PEG-distearyl, PEG-diacylglycamide (PEG-DAG), PEG-dipalmitoyl phosphatidylethanolamine (PEG-DPPE), or PEG-1,2-dimyristyloxlpropyl-3-amine (PEG-c-DMA). In some embodiments, the PEG moiety has a size of about 1000, 2000, 5000, 10,000, 15,000 or 20,000 daltons. In some embodiments, the amount of PEG-lipid in the lipid composition ranges from about 0.1 mol % to about 5 mol %.

In some embodiments, the LNP formulations described herein can additionally comprise a permeability enhancer molecule. Non-limiting permeability enhancer molecules are described in U.S. Pub. No. US20050222064, herein incorporated by reference in its entirety.

The LNP formulations can further contain a phosphate conjugate. The phosphate conjugate can increase in vivo circulation times and/or increase the targeted delivery of the nanoparticle. Phosphate conjugates can be made by the methods described in, e.g., Intl. Pub. No. WO2013033438 or U.S. Pub. No. US20130196948. The LNP formulation may also contain a polymer conjugate (e.g., a water soluble conjugate) as described in, e.g., U.S. Pub. Nos. US20130059360, US20130196948, and US20130072709. Each of the references is herein incorporated by reference in its entirety.

The LNP formulations can comprise a conjugate to enhance the delivery of nanoparticles of the present disclosure in a subject. Further, the conjugate can inhibit phagocytic clearance of the nanoparticles in a subject. In some embodiments, the conjugate may be a "self" peptide designed from the human membrane protein CD47 (e.g., the "self" particles described by Rodriguez et al, Science 2013 339, 971-975, herein incorporated by reference in its entirety). As shown by Rodriguez et al. the self-peptides delayed macrophage-mediated clearance of nanoparticles which enhanced delivery of the nanoparticles.

The LNP formulations can comprise a carbohydrate carrier. As a non-limiting example, the carbohydrate carrier can include, but is not limited to, an anhydride-modified phytoglycogen or glycogen-type material, phytoglycogen octenyl succinate, phytoglycogen beta-dextrin, anhydride-modified phytoglycogen beta-dextrin (e.g., Intl. Pub. No. WO2012109121, herein incorporated by reference in its entirety).

The LNP formulations can be coated with a surfactant or polymer to improve the delivery of the particle. In some embodiments, the LNP may be coated with a hydrophilic coating such as, but not limited to, PEG coatings and/or coatings that have a neutral surface charge as described in U.S. Pub. No. US20130183244, herein incorporated by reference in its entirety.

The LNP formulations can be engineered to alter the surface properties of particles so that the lipid nanoparticles may penetrate the mucosal barrier as described in U.S. Pat. No. 8,241,670 or Intl. Pub. No. WO2013110028, each of which is herein incorporated by reference in its entirety.

The LNP engineered to penetrate mucus can comprise a polymeric material (i.e., a polymeric core) and/or a polymer-vitamin conjugate and/or a tri-block co-polymer. The polymeric material can include, but is not limited to, polyamines, polyethers, polyamides, polyesters, polycarbamates, polyureas, polycarbonates, poly(styrenes), polyimides, polysulfones, polyurethanes, polyacetylenes, polyethylenes, polyethyeneimines, polyisocyanates, polyacrylates, polymethacrylates, polyacrylonitriles, and polyarylates.

LNP engineered to penetrate mucus can also include surface altering agents such as, but not limited to, polynucleotides, anionic proteins (e.g., bovine serum albumin), surfactants (e.g., cationic surfactants such as for example dimethyldioctadecyl-ammonium bromide), sugars or sugar derivatives (e.g., cyclodextrin), nucleic acids, polymers (e.g., heparin, polyethylene glycol and poloxamer), mucolytic agents (e.g., N-acetylcysteine, mugwort, bromelain, papain, clerodendrum, acetylcysteine, bromhexine, carbocisteine, eprazinone, mesna, ambroxol, sobrerol, domiodol, letosteine, stepronin, tiopronin, gelsolin, thymosin β4 dornase alfa, neltenexine, erdosteine) and various DNases including rhDNase.

In some embodiments, the mucus penetrating LNP can be a hypotonic formulation comprising a mucosal penetration enhancing coating. The formulation can be hypotonic for the epithelium to which it is being delivered. Non-limiting examples of hypotonic formulations may be found in, e.g., Intl. Pub. No. WO2013110028, herein incorporated by reference in its entirety.

In some embodiments, the polynucleotide described herein is formulated as a lipoplex, such as, without limitation, the ATUPLEX™ system, the DACC system, the DBTC system and other siRNA-lipoplex technology from Silence Therapeutics (London, United Kingdom), STEMFECT™ from STEMGENT® (Cambridge, Mass.), and polyethylenimine (PEI) or protamine-based targeted and non-targeted delivery of nucleic acids (Aleku et al. Cancer Res. 2008 68:9788-9798; Strumberg et al. Int J Clin Pharmacol Ther 2012 50:76-78; Santel et al., Gene Ther 2006 13:1222-1234; Santel et al., Gene Ther 2006 13:1360-1370; Gutbier et al., Pulm Pharmacol. Ther. 2010 23:334-344; Kaufmann et al. Microvasc Res 2010 80:286-293 Weide et al. J Immunother. 2009 32:498-507; Weide et al. J Immunother. 2008 31:180-188; Pascolo Expert Opin. Biol. Ther. 4:1285-1294; Fotin-Mleczek et al., 2011 J. Immunother. 34:1-15; Song et al., Nature Biotechnol. 2005, 23:709-717; Peer et al., Proc Natl Acad Sci USA. 2007 6; 104:4095-4100; deFougerolles Hum Gene Ther. 2008 19:125-132; all of which are incorporated herein by reference in its entirety).

In some embodiments, the polynucleotides described herein are formulated as a solid lipid nanoparticle (SLN), which may be spherical with an average diameter between 10 to 1000 nm. SLN possess a solid lipid core matrix that can solubilize lipophilic molecules and may be stabilized with surfactants and/or emulsifiers. Exemplary SLN can be those as described in Intl. Pub. No. WO2013105101, herein incorporated by reference in its entirety.

In some embodiments, the polynucleotides described herein can be formulated for controlled release and/or targeted delivery. As used herein, "controlled release" refers to a pharmaceutical composition or compound release profile that conforms to a particular pattern of release to effect a therapeutic outcome. In one embodiment, the polynucleotides can be encapsulated into a delivery agent described herein and/or known in the art for controlled release and/or targeted delivery. As used herein, the term "encapsulate" means to enclose, surround or encase. As it relates to the formulation of the compounds of the disclosure, encapsulation may be substantial, complete or partial. The term "substantially encapsulated" means that at least greater than 50, 60, 70, 80, 85, 90, 95, 96, 97, 98, 99, 99.9, 99.9 or greater than 99.999% of the pharmaceutical composition or compound of the disclosure may be enclosed, surrounded or encased within the delivery agent. "Partially encapsulation" means that less than 10, 10, 20, 30, 40 50 or less of the pharmaceutical composition or compound of the disclosure may be enclosed, surrounded or encased within the delivery agent.

Advantageously, encapsulation can be determined by measuring the escape or the activity of the pharmaceutical composition or compound of the disclosure using fluorescence and/or electron micrograph. For example, at least 1, 5, 10, 20, 30, 40, 50, 60, 70, 80, 85, 90, 95, 96, 97, 98, 99, 99.9, 99.99 or greater than 99.99% of the pharmaceutical composition or compound of the disclosure are encapsulated in the delivery agent.

In some embodiments, the polynucleotide controlled release formulation can include at least one controlled release coating (e.g., OPADRY®, EUDRAGIT RL®, EUDRAGIT RS® and cellulose derivatives such as ethylcellulose aqueous dispersions (AQUACOAT® and SURELEASE®)). In some embodiments, the polynucleotide controlled release formulation can comprise a polymer system as described in U.S. Pub. No. US20130130348, or a PEG and/or PEG related polymer derivative as described in U.S. Pat. No. 8,404,222, each of which is incorporated by reference in its entirety.

In some embodiments, the polynucleotides described herein can be encapsulated in a therapeutic nanoparticle, referred to herein as "therapeutic nanoparticle polynucleotides." Therapeutic nanoparticles may be formulated by methods described in, e.g., Intl. Pub. Nos. WO2010005740, WO2010030763, WO2010005721, WO2010005723, and WO2012054923; and U.S. Pub. Nos. US20110262491, US20100104645, US20100087337, US20100068285, US20110274759, US20100068286, US20120288541, US20120140790, US20130123351 and US20130230567; and U.S. Pat. Nos. 8,206,747, 8,293,276, 8,318,208 and 8,318,211, each of which is herein incorporated by reference in its entirety.

In some embodiments, the therapeutic nanoparticle polynucleotide can be formulated for sustained release. As used herein, "sustained release" refers to a pharmaceutical composition or compound that conforms to a release rate over a specific period of time. The period of time may include, but is not limited to, hours, days, weeks, months and years. As a non-limiting example, the sustained release nanoparticle of the polynucleotides described herein can be formulated as disclosed in Intl. Pub. No. WO2010075072 and U.S. Pub. Nos. US20100216804, US20110217377, US20120201859 and US20130150295, each of which is herein incorporated by reference in their entirety.

In some embodiments, the therapeutic nanoparticle polynucleotide can be formulated to be target specific, such as those described in Intl. Pub. Nos. WO2008121949, WO2010005726, WO2010005725, WO2011084521 and WO2011084518; and U.S. Pub. Nos. US20100069426, US20120004293 and US20100104655, each of which is herein incorporated by reference in its entirety.

The LNPs can be prepared using microfluidic mixers or micromixers. Exemplary microfluidic mixers can include, but are not limited to, a slit interdigitial micromixer including, but not limited to those manufactured by Microinnova (Allerheiligen bei Wildon, Austria) and/or a staggered herringbone micromixer (SHM) (see Zhigaltsev et al., "Bottom-up design and synthesis of limit size lipid nanoparticle systems with aqueous and triglyceride cores using millisecond microfluidic mixing," Langmuir 28:3633-40 (2012); Belliveau et al., "Microfluidic synthesis of highly potent limit-size lipid nanoparticles for in vivo delivery of siRNA," Molecular Therapy-Nucleic Acids. 1:e37 (2012); Chen et al., "Rapid discovery of potent siRNA-containing lipid nanoparticles enabled by controlled microfluidic formulation," J. Am. Chem. Soc. 134(16):6948-51 (2012); each of which is herein incorporated by reference in its entirety). Exemplary micromixers include Slit Interdigital Microstructured Mixer (SIMM-V2) or a Standard Slit Interdigital Micro Mixer (SSIMM) or Caterpillar (CPMM) or Impinging-jet (IJMM) from the Institut für Mikrotechnik Mainz GmbH, Mainz Germany. In some embodiments, methods of making LNP using SHM further comprise mixing at least two input streams wherein mixing occurs by microstructure-induced chaotic advection (MICA). According to this method, fluid streams flow through channels present in a herringbone pattern causing rotational flow and folding the fluids around each other. This method can also comprise a surface for fluid mixing wherein the surface changes orientations during fluid cycling. Methods of generating LNPs using SHM include those disclosed in U.S. Pub. Nos. US20040262223 and US20120276209, each of which is incorporated herein by reference in their entirety.

In some embodiments, the polynucleotides described herein can be formulated in lipid nanoparticles using microfluidic technology (see Whitesides, George M., "The Origins and the Future of Microfluidics," Nature 442: 368-373 (2006); and Abraham et al., "Chaotic Mixer for Microchannels," Science 295: 647-651 (2002); each of which is herein incorporated by reference in its entirety). In some embodiments, the polynucleotides can be formulated in lipid nanoparticles using a micromixer chip such as, but not limited to, those from Harvard Apparatus (Holliston, Mass.) or Dolomite Microfluidics (Royston, UK). A micromixer chip can be used for rapid mixing of two or more fluid streams with a split and recombine mechanism.

In some embodiments, the polynucleotides described herein can be formulated in lipid nanoparticles having a diameter from about 1 nm to about 100 nm such as, but not limited to, about 1 nm to about 20 nm, from about 1 nm to about 30 nm, from about 1 nm to about 40 nm, from about 1 nm to about 50 nm, from about 1 nm to about 60 nm, from about 1 nm to about 70 nm, from about 1 nm to about 80 nm, from about 1 nm to about 90 nm, from about 5 nm to about from 100 nm, from about 5 nm to about 10 nm, about 5 nm to about 20 nm, from about 5 nm to about 30 nm, from about 5 nm to about 40 nm, from about 5 nm to about 50 nm, from about 5 nm to about 60 nm, from about 5 nm to about 70 nm, from about 5 nm to about 80 nm, from about 5 nm to about 90 nm, about 10 to about 20 nm, about 10 to about 30 nm, about 10 to about 40 nm, about 10 to about 50 nm, about 10 to about 60 nm, about 10 to about 70 nm, about 10 to about 80 nm, about 10 to about 90 nm, about 20 to about 30 nm, about 20 to about 40 nm, about 20 to about 50 nm, about 20 to about 60 nm, about 20 to about 70 nm, about 20 to about 80 nm, about 20 to about 90 nm, about 20 to about 100 nm, about 30 to about 40 nm, about 30 to about 50 nm, about 30 to about 60 nm, about 30 to about 70 nm, about 30 to about 80 nm, about 30 to about 90 nm, about 30 to about 100 nm, about 40 to about 50 nm, about 40 to about 60 nm, about 40 to about 70 nm, about 40 to about 80 nm, about 40 to about 90 nm, about 40 to about 100 nm, about 50 to about 60 nm, about 50 to about 70 nm about 50 to about 80 nm, about 50 to about 90 nm, about 50 to about 100 nm, about 60 to about 70 nm, about 60 to about 80 nm, about 60 to about 90 nm, about 60 to about 100 nm, about 70 to about 80 nm, about 70 to about 90 nm, about 70 to about 100 nm, about 80 to about 90 nm, about 80 to about 100 nm and/or about 90 to about 100 nm.

In some embodiments, the lipid nanoparticles can have a diameter from about 10 to 500 nm. In one embodiment, the lipid nanoparticle may have a diameter greater than 100 nm, greater than 150 nm, greater than 200 nm, greater than 250 nm, greater than 300 nm, greater than 350 nm, greater than 400 nm, greater than 450 nm, greater than 500 nm, greater than 550 nm, greater than 600 nm, greater than 650 nm, greater than 700 nm, greater than 750 nm, greater than 800 nm, greater than 850 nm, greater than 900 nm, greater than 950 nm or greater than 1000 nm.

In some embodiments, the polynucleotides can be delivered using smaller LNPs. Such particles may comprise a diameter from below 0.1 µm up to 100 nm such as, but not limited to, less than 0.1 µm, less than 1.0 µm, less than 5 µm, less than 10 µm, less than 15 um, less than 20 um, less than 25 um, less than 30 um, less than 35 um, less than 40 um, less than 50 um, less than 55 um, less than 60 um, less than 65 um, less than 70 um, less than 75 um, less than 80 um, less than 85 um, less than 90 um, less than 95 um, less than 100 um, less than 125 um, less than 150 um, less than 175 um, less than 200 um, less than 225 um, less than 250 um, less than 275 um, less than 300 um, less than 325 um, less than 350 um, less than 375 um, less than 400 um, less than 425 um, less than 450 um, less than 475 um, less than 500 um, less than 525 um, less than 550 um, less than 575 um, less than 600 um, less than 625 um, less than 650 um, less than 675 um, less than 700 um, less than 725 um, less than 750 um, less than 775 um, less than 800 um, less than 825 um, less than 850 um, less than 875 um, less than 900 um, less than 925 um, less than 950 um, or less than 975 um.

The nanoparticles and microparticles described herein can be geometrically engineered to modulate macrophage and/or the immune response. The geometrically engineered particles can have varied shapes, sizes and/or surface charges to incorporate the polynucleotides described herein for targeted delivery such as, but not limited to, pulmonary delivery (see, e.g., Intl. Pub. No. WO2013082111, herein incorporated by reference in its entirety). Other physical features the geometrically engineering particles can include, but are not limited to, fenestrations, angled arms, asymmetry and surface roughness, charge that can alter the interactions with cells and tissues. In some embodiment, the nanoparticles described herein are stealth nanoparticles or target-specific stealth nanoparticles such as, but not limited to, those described in U.S. Pub. No. US20130172406, herein incorporated by reference in its entirety. The stealth or target-specific stealth nanoparticles can comprise a polymeric matrix, which may comprise two or more polymers such as, but not limited to, polyethylenes, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polyesters, polyanhydrides, polyethers, polyurethanes, polymethacrylates, polyacrylates, polycyanoacrylates, or combinations thereof.

b. Lipidoids

In some embodiments, the compositions or formulations of the present disclosure comprise a delivery agent, e.g., a lipidoid. The polynucleotides described herein can be formulated with lipidoids. Complexes, micelles, liposomes or particles can be prepared containing these lipidoids and therefore to achieve an effective delivery of the polynucleotide, as judged by the production of an encoded protein, following the injection of a lipidoid formulation via localized and/or systemic routes of administration. Lipidoid complexes of polynucleotides can be administered by various means including, but not limited to, intravenous, intramuscular, or subcutaneous routes.

The synthesis of lipidoids is described in literature (see Mahon et al., Bioconjug. Chem. 2010 21:1448-1454; Schroeder et al., J Intern Med. 2010 267:9-21; Akinc et al., Nat Biotechnol. 2008 26:561-569; Love et al., Proc Natl Acad Sci USA. 2010 107:1864-1869; Siegwart et al., Proc Natl Acad Sci USA. 2011 108:12996-3001; all of which are incorporated herein in their entireties).

Formulations with the different lipidoids, including, but not limited to penta[3-(1-laurylaminopropionyl)]-triethylenetetramine hydrochloride (TETA-5LAP; also known as 98N12-5, see Murugaiah et al., Analytical Biochemistry, 401:61 (2010)), C12-200 (including derivatives and variants), and MD1, can be tested for in vivo activity. The lipidoid "98N12-5" is disclosed by Akinc et al., Mol Ther. 2009 17:872-879. The lipidoid "C12-200" is disclosed by Love et al., Proc Natl Acad Sci USA. 2010 107:1864-1869 and Liu and Huang, Molecular Therapy. 2010 669-670. Each of the references is herein incorporated by reference in its entirety.

In one embodiment, the polynucleotides described herein can be formulated in an aminoalcohol lipidoid. Aminoalcohol lipidoids may be prepared by the methods described in U.S. Pat. No. 8,450,298 (herein incorporated by reference in its entirety).

The lipidoid formulations can include particles comprising either 3 or 4 or more components in addition to polynucleotides. Lipidoids and polynucleotide formulations comprising lipidoids are described in Intl. Pub. No. WO 2015051214 (herein incorporated by reference in its entirety.

c. Hyaluronidase

In some embodiments, the polynucleotides described herein and hyaluronidase for injection (e.g., intramuscular or subcutaneous injection). Hyaluronidase catalyzes the hydrolysis of hyaluronan, which is a constituent of the interstitial barrier. Hyaluronidase lowers the viscosity of hyaluronan, thereby increases tissue permeability (Frost, Expert Opin. Drug Deliv. (2007) 4:427-440). Alternatively, the hyaluronidase can be used to increase the number of cells exposed to the polynucleotides administered intramuscularly, intratumorally, or subcutaneously.

d. Nanoparticle Mimics

In some embodiments, the polynucleotides described herein is encapsulated within and/or absorbed to a nanoparticle mimic. A nanoparticle mimic can mimic the delivery function organisms or particles such as, but not limited to, pathogens, viruses, bacteria, fungus, parasites, prions and cells. As a non-limiting example, the polynucleotides described herein can be encapsulated in a non-viron particle that can mimic the delivery function of a virus (see e.g., Intl. Pub. No. WO2012006376 and U.S. Pub. Nos. US20130171241 and US20130195968, each of which is herein incorporated by reference in its entirety).

e. Nanotubes

In some embodiments, the compositions or formulations of the present disclosure comprise the polynucleotides described herein attached or otherwise bound to (e.g., through steric, ionic, covalent and/or other forces) at least one nanotube, such as, but not limited to, rosette nanotubes, rosette nanotubes having twin bases with a linker, carbon nanotubes and/or single-walled carbon nanotubes. Nanotubes and nanotube formulations comprising a polynucleotide are described in, e.g., Intl. Pub. No. WO2014152211, herein incorporated by reference in its entirety.

f. Self-Assembled Nanoparticles, or Self-Assembled Macromolecules

In some embodiments, the compositions or formulations of the present disclosure comprise the polynucleotides described herein in self-assembled nanoparticles, or amphiphilic macromolecules (AMs) for delivery. AMs comprise biocompatible amphiphilic polymers that have an alkylated sugar backbone covalently linked to poly(ethylene glycol). In aqueous solution, the AMs self-assemble to form micelles. Nucleic acid self-assembled nanoparticles are described in Intl. Appl. No. PCT/US2014/027077, and AMs and methods of forming AMs are described in U.S. Pub. No. US20130217753, each of which is herein incorporated by reference in its entirety.

g. Inorganic Nanoparticles, Semi-Conductive and Metallic Nanoparticles

In some embodiments, the compositions or formulations of the present disclosure comprise the polynucleotides described herein in inorganic nanoparticles, or water-dispersible nanoparticles comprising a semiconductive or metallic material. The inorganic nanoparticles can include, but are not limited to, clay substances that are water swellable. The water-dispersible nanoparticles can be hydrophobic or hydrophilic nanoparticles. As a non-limiting example, the inorganic, semi-conductive and metallic nanoparticles are described in, e.g., U.S. Pat. Nos. 5,585,108 and 8,257,745; and U.S. Pub. Nos. US20120228565, US 20120265001 and US 20120283503, each of which is herein incorporated by reference in their entirety.

h. Surgical Sealants: Gels and Hydrogels

In some embodiments, the compositions or formulations of the present disclosure comprise the polynucleotides described herein in a surgical sealant. Surgical sealants such as gels and hydrogels are described in Intl. Appl. No. PCT/US2014/027077, herein incorporated by reference in its entirety.

i. Suspension Formulations

In some embodiments, the compositions or formulations of the present disclosure comprise the polynucleotides described herein in suspensions. In some embodiments, suspensions comprise a polynucleotide, water immiscible oil depots, surfactants and/or co-surfactants and/or co-solvents. Suspensions can be formed by first preparing an aqueous solution of a polynucleotide and an oil-based phase comprising one or more surfactants, and then mixing the two phases (aqueous and oil-based).

Exemplary oils for suspension formulations can include, but are not limited to, sesame oil and Miglyol (comprising esters of saturated coconut and palmkernel oil-derived caprylic and capric fatty acids and glycerin or propylene glycol), corn oil, soybean oil, peanut oil, beeswax and/or palm seed oil. Exemplary surfactants can include, but are not limited to Cremophor, polysorbate 20, polysorbate 80, polyethylene glycol, transcutol, Capmul®, labrasol, isopropyl myristate, and/or Span 80. In some embodiments, suspensions can comprise co-solvents including, but not limited to ethanol, glycerol and/or propylene glycol.

In some embodiments, suspensions can provide modulation of the release of the polynucleotides into the surrounding environment by diffusion from a water immiscible depot followed by resolubilization into a surrounding environment (e.g., an aqueous environment).

In some embodiments, the polynucleotides can be formulated such that upon injection, an emulsion forms spontaneously (e.g., when delivered to an aqueous phase), which may provide a high surface area to volume ratio for release of polynucleotides from an oil phase to an aqueous phase. In some embodiments, the polynucleotide is formulated in a nanoemulsion, which can comprise a liquid hydrophobic core surrounded by or coated with a lipid or surfactant layer. Exemplary nanoemulsions and their preparations are described in, e.g., U.S. Pat. No. 8,496,945, herein incorporated by reference in its entirety.

j. Cations and Anions

In some embodiments, the compositions or formulations of the present disclosure comprise the polynucleotides described herein and a cation or anion, such as $Zn^{2+}$, $Ca^{2+}$, $Cu^{2+}$, $Mg^{2+}$ and combinations thereof. Exemplary formulations can include polymers and a polynucleotide complexed with a metal cation as described in, e.g., U.S. Pat. Nos. 6,265,389 and 6,555,525, each of which is herein incorporated by reference in its entirety. In some embodiments, cationic nanoparticles can contain a combination of divalent and monovalent cations. The delivery of polynucleotides in cationic nanoparticles or in one or more depot comprising cationic nanoparticles may improve polynucleotide bioavailability by acting as a long-acting depot and/or reducing the rate of degradation by nucleases.

k. Molded Nanoparticles and Microparticles

In some embodiments, the compositions or formulations of the present disclosure comprise the polynucleotides described herein in molded nanoparticles in various sizes, shapes and chemistry. For example, the nanoparticles and/or microparticles can be made using the PRINT® technology by LIQUIDA TECHNOLOGIES® (Morrisville, N.C.) (e.g., International Pub. No. WO2007024323, herein incorporated by reference in its entirety).

In some embodiments, the polynucleotides described herein is formulated in microparticles. The microparticles may contain a core of the polynucleotide and a cortex of a biocompatible and/or biodegradable polymer, including but not limited to, poly(α-hydroxy acid), a polyhydroxy butyric acid, a polycaprolactone, a polyorthoester and a polyanhydride. The microparticle may have adsorbent surfaces to adsorb polynucleotides. The microparticles may have a diameter of from at least 1 micron to at least 100 microns (e.g., at least 1 micron, at least 10 micron, at least 20 micron, at least 30 micron, at least 50 micron, at least 75 micron, at least 95 micron, and at least 100 micron). In some embodiment, the compositions or formulations of the present disclosure are microemulsions comprising microparticles and polynucleotides. Exemplary microparticles, microemulsions and their preparations are described in, e.g., U.S. Pat. Nos. 8,460,709, 8,309,139 and 8,206,749; U.S. Pub. Nos. US20130129830, US2013195923 and US20130195898; and Intl. Pub. No. WO2013075068, each of which is herein incorporated by reference in its entirety.

l. NanoJackets and NanoLiposomes

In some embodiments, the compositions or formulations of the present disclosure comprise the polynucleotides described hereinin NanoJackets and NanoLiposomes by Keystone Nano (State College, Pa.). NanoJackets are made of materials that are naturally found in the body including calcium, phosphate and may also include a small amount of silicates. Nanojackets may have a size ranging from 5 to 50 nm.

NanoLiposomes are made of lipids such as, but not limited to, lipids that naturally occur in the body. NanoLiposomes may have a size ranging from 60-80 nm. In some embodiments, the polynucleotides disclosed herein are formulated in a NanoLiposome such as, but not limited to, Ceramide NanoLiposomes.

m. Cells or Minicells

In some embodiments, the compositions or formulations of the present disclosure comprise the polynucleotides described herein that is transfected ex vivo into cells, which are subsequently transplanted into a subject. Cell-based formulations of the polynucleotide disclosed herein can be used to ensure cell transfection (e.g., in the cellular carrier), alter the biodistribution of the polynucleotide (e.g., by targeting the cell carrier to specific tissues or cell types), and/or increase the translation of encoded protein.

Exemplary cells include, but are not limited to, red blood cells, virosomes, and electroporated cells (see e.g., Godfrin et al., Expert Opin Biol Ther. 2012 12:127-133; Fang et al., Expert Opin Biol Ther. 2012 12:385-389; Hu et al., Proc Natl Acad Sci USA. 2011 108:10980-10985; Lund et al., Pharm Res. 2010 27:400-420; Huckriede et al., J Liposome Res. 2007; 17:39-47; Cusi, Hum Vaccin. 2006 2:1-7; de Jonge et al., Gene Ther. 2006 13:400-411; all of which are herein incorporated by reference in its entirety).

A variety of methods are known in the art and are suitable for introduction of nucleic acid into a cell, including viral and non-viral mediated techniques. Examples of typical non-viral mediated techniques include, but are not limited to, electroporation, calcium phosphate mediated transfer, nucleofection, sonoporation, heat shock, magnetofection, liposome mediated transfer, microinjection, microprojectile mediated transfer (nanoparticles), cationic polymer mediated transfer (DEAE-dextran, polyethylenimine, polyethylene glycol (PEG) and the like) or cell fusion.

In some embodiments, the polynucleotides described herein can be delivered in synthetic virus-like particles (VLPs) synthesized by the methods as described in Intl. Pub Nos. WO2011085231 and WO2013116656; and U.S. Pub. No. 20110171248, each of which is herein incorporated by reference in its entirety.

The technique of sonoporation, or cellular sonication, is the use of sound (e.g., ultrasonic frequencies) for modifying the permeability of the cell plasma membrane. Sonoporation methods are known to deliver nucleic acids in vivo (Yoon and Park, Expert Opin Drug Deliv. 2010 7:321-330; Postema and Gilja, Curr Pharm Biotechnol. 2007 8:355-361; Newman and Bettinger, Gene Ther. 2007 14:465-475; U.S. Pub. Nos. US20100196983 and US20100009424; all herein incorporated by reference in their entirety).

In some embodiments, the polynucleotides described herein can be delivered by electroporation. Electroporation techniques are known to deliver nucleic acids in vivo and clinically (Andre et al., Curr Gene Ther. 2010 10:267-280; Chiarella et al., Curr Gene Ther. 2010 10:281-286; Hojman, Curr Gene Ther. 2010 10:128-138; all herein incorporated by reference in their entirety). Electroporation devices are sold by many companies worldwide including, but not limited to BTX® Instruments (Holliston, Mass.) (e.g., the AgilePulse In vivo System) and Inovio (Blue Bell, Pa.) (e.g., Inovio SP-5P intramuscular delivery device or the CEL-LECTRA® 3000 intradermal delivery device).

In some embodiments, the cells are selected from the group consisting of mammalian cells, bacterial cells, plant, microbial, algal and fungal cells. In some embodiments, the cells are mammalian cells, such as, but not limited to, human, mouse, rat, goat, horse, rabbit, hamster or cow cells. In a further embodiment, the cells can be from an established cell line, including, but not limited to, HeLa, NS0, SP2/0, KEK 293T, Vero, Caco, Caco-2, MDCK, COS-1, COS-7, K562, Jurkat, CHO-K1, DG44, CHOK1SV, CHO-S, Huvec, CV-1, Huh-7, NIH3T3, HEK293, 293, A549, HepG2, IMR-90, MCF-7, U-20S, Per.C6, SF9, SF21 or Chinese Hamster Ovary (CHO) cells. In certain embodiments, the cells are fungal cells, such as, but not limited to, *Chrysosporium* cells, *Aspergillus* cells, *Trichoderma* cells, *Dictyostelium* cells, *Candida* cells, *Saccharomyces* cells, *Schizosaccharomyces* cells, and *Penicillium* cells.

In certain embodiments, the cells are bacterial cells such as, but not limited to, *E. coli, B. subtilis*, or BL21 cells. Primary and secondary cells to be transfected by the methods of the disclosure can be obtained from a variety of tissues and include, but are not limited to, all cell types that can be maintained in culture. The primary and secondary cells include, but are not limited to, fibroblasts, keratinocytes, epithelial cells (e.g., mammary epithelial cells, intestinal epithelial cells), endothelial cells, glial cells, neural cells, formed elements of the blood (e.g., lymphocytes, bone marrow cells), muscle cells and precursors of these somatic cell types. Primary cells may also be obtained from a donor of the same species or from another species (e.g., mouse, rat, rabbit, cat, dog, pig, cow, bird, sheep, goat, horse).

In some embodiments, the compositions or formulations of the present disclosure comprise the polynucleotides described herein in bacterial minicells. As a non-limiting example, bacterial minicells can be those described in Intl. Pub. No. WO2013088250 or U.S. Pub. No. US20130177499, each of which is herein incorporated by reference in its entirety.

n. Semi-Solid Compositions

In some embodiments, the compositions or formulations of the present disclosure comprise the polynucleotides described herein in a hydrophobic matrix to form a semi-solid or paste-like composition. As a non-limiting example, the semi-solid or paste-like composition can be made by the methods described in Intl. Pub. No. WO201307604, herein incorporated by reference in its entirety.

o. Exosomes

In some embodiments, the compositions or formulations of the present disclosure comprise the polynucleotides described herein in exosomes, which can be loaded with at least one polynucleotide and delivered to cells, tissues and/or organisms. As a non-limiting example, the polynucleotides can be loaded in the exosomes as described in Intl. Pub. No. WO2013084000, herein incorporated by reference in its entirety.

p. Silk-Based Delivery

In some embodiments, the compositions or formulations of the present disclosure comprise the polynucleotides described herein that is formulated for silk-based delivery. The silk-based delivery system can be formed by contacting a silk fibroin solution with a polynucleotide described herein. As a non-limiting example, a sustained release silk-based delivery system and methods of making such system are described in U.S. Pub. No. US20130177611, herein incorporated by reference in its entirety.

q. Amino Acid Lipids

In some embodiments, the compositions or formulations of the present disclosure comprise the polynucleotides described herein that is formulation with an amino acid lipid. Amino acid lipids are lipophilic compounds comprising an amino acid residue and one or more lipophilic tails. Non-limiting examples of amino acid lipids and methods of making amino acid lipids are described in U.S. Pat. No. 8,501,824. The amino acid lipid formulations may deliver a polynucleotide in releasable form that comprises an amino acid lipid that binds and releases the polynucleotides. As a non-limiting example, the release of the polynucleotides described herein can be provided by an acid-labile linker as described in, e.g., U.S. Pat. Nos. 7,098,032, 6,897,196, 6,426,086, 7,138,382, 5,563,250, and 5,505,931, each of which is herein incorporated by reference in its entirety.

r. Microvesicles

In some embodiments, the compositions or formulations of the present disclosure comprise the polynucleotides described herein in a microvesicle formulation. Exemplary microvesicles include those described in U.S. Pub. No. US20130209544 (herein incorporated by reference in its entirety). In some embodiments, the microvesicle is an ARRDC1-mediated microvesicles (ARMMs) as described in Intl. Pub. No. WO2013119602 (herein incorporated by reference in its entirety).

s. Interpolyelectrolyte Complexes

In some embodiments, the compositions or formulations of the present disclosure comprise the polynucleotides described herein in an interpolyelectrolyte complex. Interpolyelectrolyte complexes are formed when charge-dynamic polymers are complexed with one or more anionic molecules. Non-limiting examples of charge-dynamic polymers and interpolyelectrolyte complexes and methods of making interpolyelectrolyte complexes are described in U.S. Pat. No. 8,524,368, herein incorporated by reference in its entirety.

t. Crystalline Polymeric Systems

In some embodiments, the compositions or formulations of the present disclosure comprise the polynucleotides described hereinin crystalline polymeric systems. Crystalline polymeric systems are polymers with crystalline moieties and/or terminal units comprising crystalline moieties. Exemplary polymers are described in U.S. Pat. No. 8,524,259 (herein incorporated by reference in its entirety).

u. Polymers, Biodegradable Nanoparticles, and Core-Shell Nanoparticles

In some embodiments, the compositions or formulations of the present disclosure comprise the polynucleotides described herein and a natural and/or synthetic polymer. The polymers include, but not limited to, polyethenes, polyethylene glycol (PEG), poly(l-lysine)(PLL), PEG grafted to PLL, cationic lipopolymer, biodegradable cationic lipopolymer, polyethyleneimine (PEI), cross-linked branched poly (alkylene imines), a polyamine derivative, a modified poloxamer, elastic biodegradable polymer, biodegradable copolymer, biodegradable polyester copolymer, biodegradable polyester copolymer, multiblock copolymers, poly[α-(4-aminobutyl)-L-glycolic acid) (PAGA), biodegradable cross-linked cationic multi-block copolymers, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyureas, polystyrenes, polyamines, polylysine, poly(ethylene imine), poly(serine ester), poly(L-lactide-co-L-lysine), poly(4-hydroxy-L-proline ester), amine-containing polymers, dextran polymers, dextran polymer derivatives or combinations thereof.

Exemplary polymers include, DYNAMIC POLYCONJUGATE® (Arrowhead Research Corp., Pasadena, Calif.) formulations from MIRUS® Bio (Madison, Wis.) and Roche Madison (Madison, Wis.), PHASERX™ polymer formulations such as, without limitation, SMARTT POLYMER TECHNOLOGY™ (PHASERX®, Seattle, Wash.), DMRI/DOPE, poloxamer, VAXFECTIN® adjuvant from Vical (San Diego, Calif.), chitosan, cyclodextrin from Calando Pharmaceuticals (Pasadena, Calif.), dendrimers and poly (lactic-co-glycolic acid) (PLGA) polymers. RONDEL™ (RNAi/Oligonucleotide Nanoparticle Delivery) polymers (Arrowhead Research Corporation, Pasadena, Calif.) and pH responsive co-block polymers such as PHASERX® (Seattle, Wash.).

The polymer formulations allow a sustained or delayed release of the polynucleotide (e.g., following intramuscular or subcutaneous injection). The altered release profile for the polynucleotide can result in, for example, translation of an encoded protein over an extended period of time. The polymer formulation can also be used to increase the stability of the polynucleotide. Sustained release formulations can include, but are not limited to, PLGA microspheres, ethylene vinyl acetate (EVAc), poloxamer, GELSITE® (Nanotherapeutics, Inc. Alachua, Fla.), HYLENEX® (Halozyme Therapeutics, San Diego Calif.), surgical sealants such as fibrinogen polymers (Ethicon Inc. Cornelia, Ga.), TISSELL® (Baxter International, Inc. Deerfield, Ill.), PEG-based sealants, and COSEAL® (Baxter International, Inc. Deerfield, Ill.).

As a non-limiting example modified mRNA can be formulated in PLGA microspheres by preparing the PLGA microspheres with tunable release rates (e.g., days and weeks) and encapsulating the modified mRNA in the PLGA microspheres while maintaining the integrity of the modified mRNA during the encapsulation process. EVAc are non-biodegradable, biocompatible polymers that are used extensively in pre-clinical sustained release implant applications (e.g., extended release products Ocusert a pilocarpine ophthalmic insert for glaucoma or progestasert a sustained release progesterone intrauterine device; transdermal delivery systems Testoderm, Duragesic and Selegiline; catheters). Poloxamer F-407 NF is a hydrophilic, non-ionic surfactant triblock copolymer of polyoxyethylene-polyoxypropylene-polyoxyethylene having a low viscosity at temperatures less than 5° C. and forms a solid gel at temperatures greater than 15° C.

As a non-limiting example, the polynucleotides described herein can be formulated with the polymeric compound of PEG grafted with PLL as described in U.S. Pat. No. 6,177,274. As another non-limiting example, the polynucleotides described herein can be formulated with a block copolymer such as a PLGA-PEG block copolymer (see e.g., U.S. Pub. No. US20120004293 and U.S. Pat. Nos. 8,236,330 and 8,246,968), or a PLGA-PEG-PLGA block copolymer (see e.g., U.S. Pat. No. 6,004,573). Each of the references is herein incorporated by reference in its entirety.

In some embodiments, the polynucleotides described herein can be formulated with at least one amine-containing polymer such as, but not limited to polylysine, polyethylene imine, poly(amidoamine) dendrimers, poly(amine-co-esters) or combinations thereof. Exemplary polyamine polymers and their use as delivery agents are described in, e.g., U.S. Pat. Nos. 8,460,696, 8,236,280, each of which is herein incorporated by reference in its entirety.

In some embodiments, the polynucleotides described herein can be formulated in a biodegradable cationic lipopolymer, a biodegradable polymer, or a biodegradable copolymer, a biodegradable polyester copolymer, a biodegradable polyester polymer, a linear biodegradable copolymer, PAGA, a biodegradable cross-linked cationic multi-block copolymer or combinations thereof as described in, e.g., U.S. Pat. Nos. 6,696,038, 6,517,869, 6,267,987, 6,217,912, 6,652,886, 8,057,821, and 8,444,992; U.S. Pub. Nos. US20030073619, US20040142474, US20100004315, US2012009145 and US20130195920; and Intl Pub. Nos. WO2006063249 and WO2013086322, each of which is herein incorporated by reference in its entirety.

In some embodiments, the polynucleotides described herein can be formulated in or with at least one cyclodextrin polymer as described in U.S. Pub. No. US20130184453. In some embodiments, the polynucleotides described herein can be formulated in or with at least one crosslinked cation-binding polymers as described in Intl. Pub. Nos. WO2013106072, WO2013106073 and WO2013106086. In some embodiments, the polynucleotides described herein can be formulated in or with at least PEGylated albumin polymer as described in U.S. Pub. No. US20130231287. Each of the references is herein incorporated by reference in its entirety.

In some embodiments, the polynucleotides disclosed herein can be formulated as a nanoparticle using a combination of polymers, lipids, and/or other biodegradable agents, such as, but not limited to, calcium phosphate. Components can be combined in a core-shell, hybrid, and/or layer-by-layer architecture, to allow for fine-tuning of the nanoparticle for delivery (Wang et al., Nat Mater. 2006 5:791-796; Fuller et al., Biomaterials. 2008 29:1526-1532; DeKoker et al., Adv Drug Deliv Rev. 2011 63:748-761; Endres et al., Biomaterials. 2011 32:7721-7731; Su et al., Mol Pharm. 2011 Jun. 6; 8(3):774-87; herein incorporated by reference in their entireties). As a non-limiting example, the nanoparticle can comprise a plurality of polymers such as, but not limited to hydrophilic-hydrophobic polymers (e.g., PEG-PLGA), hydrophobic polymers (e.g., PEG) and/or hydrophilic polymers (Intl. Pub. No. WO20120225129, herein incorporated by reference in its entirety).

The use of core-shell nanoparticles has additionally focused on a high-throughput approach to synthesize cationic cross-linked nanogel cores and various shells (Siegwart et al., Proc Natl Acad Sci USA. 2011 108:12996-13001; herein incorporated by reference in its entirety). The complexation, delivery, and internalization of the polymeric nanoparticles can be precisely controlled by altering the chemical composition in both the core and shell components of the nanoparticle. For example, the core-shell nanoparticles may efficiently deliver siRNA to mouse hepatocytes after they covalently attach cholesterol to the nanoparticle.

In some embodiments, a hollow lipid core comprising a middle PLGA layer and an outer neutral lipid layer containing PEG can be used to delivery of the polynucleotides as described herein. In some embodiments, the lipid nanoparticles can comprise a core of the polynucleotides disclosed herein and a polymer shell, which is used to protect the polynucleotides in the core. The polymer shell can be any of the polymers described herein and are known in the art., the polymer shell can be used to protect the polynucleotides in the core.

Core-shell nanoparticles for use with the polynucleotides described herein are described in U.S. Pat. No. 8,313,777 or Intl. Pub. No. WO2013124867, each of which is herein incorporated by reference in their entirety.

v. Peptides and Proteins

In some embodiments, the compositions or formulations of the present disclosure comprise the polynucleotides described herein that is formulated with peptides and/or proteins to increase transfection of cells by the polynucleotide, and/or to alter the biodistribution of the polynucleotide (e.g., by targeting specific tissues or cell types), and/or increase the translation of encoded protein (e.g., Intl. Pub. Nos. WO2012110636 and WO2013123298. In some embodiments, the peptides can be those described in U.S. Pub. Nos. US20130129726, US20130137644 and US20130164219. Each of the references is herein incorporated by reference in its entirety.

w. Conjugates

In some embodiments, the compositions or formulations of the present disclosure comprise the polynucleotides described herein that is covalently linked to a carrier or targeting group, or including two encoding regions that together produce a fusion protein (e.g., bearing a targeting group and therapeutic protein or peptide) as a conjugate. The conjugate can be a peptide that selectively directs the nanoparticle to neurons in a tissue or organism, or assists in crossing the blood-brain barrier.

The conjugates include a naturally occurring substance, such as a protein (e.g., human serum albumin (HSA), low-density lipoprotein (LDL), high-density lipoprotein (HDL), or globulin); an carbohydrate (e.g., a dextran, pullulan, chitin, chitosan, inulin, cyclodextrin or hyaluronic acid); or a lipid. The ligand may also be a recombinant or synthetic molecule, such as a synthetic polymer, e.g., a synthetic polyamino acid, an oligonucleotide (e.g., an aptamer). Examples of polyamino acids include polyamino acid is a polylysine (PLL), poly L-aspartic acid, poly L-glutamic acid, styrene-maleic acid anhydride copolymer, poly (L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly(2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

In some embodiments, the conjugate can function as a carrier for the polynucleotide disclosed herein. The conjugate can comprise a cationic polymer such as, but not limited to, polyamine, polylysine, polyalkylenimine, and polyethylenimine that can be grafted to with poly(ethylene glycol). Exemplary conjugates and their preparations are described in U.S. Pat. No. 6,586,524 and U.S. Pub. No. US20130211249, each of which herein is incorporated by reference in its entirety.

The conjugates can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-glucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, biotin, an RGD peptide, an RGD peptide mimetic or an aptamer.

Targeting groups can be proteins, e.g., glycoproteins, or peptides, e.g., molecules having a specific affinity for a co-ligand, or antibodies e.g., an antibody, that binds to a specified cell type such as a cancer cell, endothelial cell, or bone cell. Targeting groups may also include hormones and hormone receptors. They can also include non-peptidic species, such as lipids, lectins, carbohydrates, vitamins, cofactors, multivalent lactose, multivalent galactose, N-acetyl-galactosamine, N-acetyl-glucosamine multivalent mannose, multivalent fructose, or aptamers. The ligand can be, for example, a lipopolysaccharide, or an activator of p38 MAP kinase.

The targeting group can be any ligand that is capable of targeting a specific receptor. Examples include, without limitation, folate, GalNAc, galactose, mannose, mannose-6P, apatamers, integrin receptor ligands, chemokine receptor ligands, transferrin, biotin, serotonin receptor ligands, PSMA, endothelin, GCPII, somatostatin, LDL, and HDL ligands. In particular embodiments, the targeting group is an aptamer. The aptamer can be unmodified or have any combination of modifications disclosed herein. As a non-limiting example, the targeting group can be a glutathione receptor (GR)-binding conjugate for targeted delivery across the blood-central nervous system barrier as described in, e.g., U.S. Pub. No. US2013021661012 (herein incorporated by reference in its entirety).

In some embodiments, the conjugate can be a synergistic biomolecule-polymer conjugate, which comprises a long-acting continuous-release system to provide a greater therapeutic efficacy. The synergistic biomolecule-polymer conjugate can be those described in U.S. Pub. No. US20130195799. In some embodiments, the conjugate can be an aptamer conjugate as described in Intl. Pat. Pub. No. WO2012040524. In some embodiments, the conjugate can be an amine containing polymer conjugate as described in U.S. Pat. No. 8,507,653. Each of the references is herein incorporated by reference in its entirety. In some embodiments, the polynucleotides can be conjugated to SMARTT POLYMER TECHNOLOGY® (PHASERX®, Inc. Seattle, Wash.).

In some embodiments, the polynucleotides described herein are covalently conjugated to a cell penetrating polypeptide, which can also include a signal sequence or a targeting sequence. The conjugates can be designed to have increased stability, and/or increased cell transfection; and/or altered the biodistribution (e.g., targeted to specific tissues or cell types).

In some embodiments, the polynucleotides described herein can be conjugated to an agent to enhance delivery. In some embodiments, the agent can be a monomer or polymer such as a targeting monomer or a polymer having targeting blocks as described in Intl. Pub. No. WO2011062965. In some embodiments, the agent can be a transport agent covalently coupled to a polynucleotide as described in, e.g., U.S. Pat. Nos. 6,835.393 and 7,374,778. In some embodiments, the agent can be a membrane barrier transport enhancing agent such as those described in U.S. Pat. Nos. 7,737,108 and 8,003,129. Each of the references is herein incorporated by reference in its entirety.

x. Micro-Organs

In some embodiments, the compositions or formulations of the present disclosure comprise the polynucleotides described hereinin a micro-organ that can then express an encoded polypeptide of interest in a long-lasting therapeutic formulation. Exemplary micro-organs and formulations are described in Intl. Pub. No. WO2014152211 (herein incorporated by reference in its entirety).

y. Pseudovirions

In some embodiments, the compositions or formulations of the present disclosure comprise the polynucleotides described herein in pseudovirions (e.g., pseudovirions developed by Aura Biosciences, Cambridge, Mass.).

In some embodiments, the pseudovirion used for delivering the polynucleotides can be derived from viruses such as, but not limited to, herpes and papillomaviruses as described in, e.g., U.S. Pub. Nos. US20130012450, US20130012566, US21030012426 and US20120207840; and Intl. Pub. No. WO2013009717, each of which is herein incorporated by reference in its entirety.

The pseudovirion can be a virus-like particle (VLP) prepared by the methods described in U.S. Pub. Nos. US20120015899 and US20130177587, and Intl. Pub. Nos. WO2010047839, WO2013116656, WO2013106525 and WO2013122262. In one aspect, the VLP can be bacteriophages MS, Qβ, R17, fr, GA, Sp, MI, I, MXI, NL95, AP205, f2, PP7, and the plant viruses Turnip crinkle virus (TCV), Tomato bushy stunt virus (TBSV), Southern bean mosaic virus (SBMV) and members of the genus Bromovirus including Broad bean mottle virus, Brome mosaic virus, *Cassia* yellow blotch virus, Cowpea chlorotic mottle virus (CCMV), *Melandrium* yellow fleck virus, and Spring beauty latent virus. In another aspect, the VLP can be derived from the influenza virus as described in U.S. Pub. No. US20130177587 and U.S. Pat. No. 8,506,967. In one aspect, the VLP can comprise a B7-1 and/or B7-2 molecule anchored to a lipid membrane or the exterior of the particle such as described in Intl. Pub. No. WO2013116656. In one aspect, the VLP can be derived from norovirus, rotavirus recombinant VP6 protein or double layered VP2/VP6 such as the VLP as described in Intl. Pub. No. WO2012049366. Each of the references is herein incorporated by reference in its entirety.

In some embodiments, the pseudovirion can be a human papilloma virus-like particle as described in Intl. Pub. No. WO2010120266 and U.S. Pub. No. US20120171290. In some embodiments, the virus-like particle (VLP) can be a self-assembled particle. In one aspect, the pseudovirions can be virion derived nanoparticles as described in U.S. Pub. Nos. US20130116408 and US20130115247; and Intl. Pub. No. WO2013119877. Each of the references is herein incorporated by reference in their entirety.

Non-limiting examples of formulations and methods for formulating the polynucleotides described herein are also provided in Intl. Pub. No WO2013090648 (incorporated herein by reference in their entirety).

27. Compositions and Formulations for Use

Certain aspects of the disclosure are directed to compositions or formulations comprising any of the polynucleotides disclosed above.

In some embodiments, the composition or formulation comprises:
(i) a polynucleotide (e.g., a RNA, e.g., an mRNA) comprising a sequence-optimized nucleotide sequence encoding an IL-12 polypeptide as disclosed herein and/or a sequence-optimized nucleotide sequence encoding a membrane domain as disclosed herein (e.g., the wild-type sequence, functional fragment, or variant thereof of the IL-12 polypeptide and/or membrane domain), wherein the polynucleotide comprises at least one chemically modified nucleobase, and wherein the polynucleotide further comprises a miRNA binding site, e.g., a miRNA binding site that binds to miR-122 (e.g., a miR-122-3p or miR-122-5p binding site); and
(ii) a delivery agent comprising a compound having Formula (I).

In some embodiments, the polynucleotides, compositions or formulations above are used to treat and/or prevent an IL-12-related diseases, disorders or conditions, e.g., cancer.

28. Forms of Administration

The polynucleotides, pharmaceutical compositions and formulations of the disclosure described above can be administered by any route that results in a therapeutically effective outcome. These include, but are not limited to enteral (into the intestine), gastroenteral, epidural (into the dura matter), oral (by way of the mouth), transdermal, peridural, intracerebral (into the cerebrum), intracerebroventricular (into the cerebral ventricles), epicutaneous (application onto the skin), intradermal, (into the skin itself), subcutaneous (under the skin), nasal administration (through the nose), intravenous (into a vein), intravenous bolus, intravenous drip, intraarterial (into an artery), intramuscular (into a muscle), intracardiac (into the heart), intraosseous infusion (into the bone marrow), intrathecal (into the spinal canal), intraperitoneal, (infusion or injection into the peritoneum), intravesical infusion, intravitreal, (through the eye), intracavernous injection (into a pathologic cavity) intracavitary (into the base of the penis), intravaginal administration, intrauterine, extra-amniotic administration, transdermal (diffusion through the intact skin for systemic distribution), transmucosal (diffusion through a mucous membrane), transvaginal, insufflation (snorting), sublingual, sublabial, enema, eye drops (onto the conjunctiva), in ear drops, auricular (in or by way of the ear), buccal (directed toward the cheek), conjunctival, cutaneous, dental (to a tooth or teeth), electro-osmosis, endocervical, endosinusial, endotracheal, extracorporeal, hemodialysis, infiltration, interstitial, intra-abdominal, intra-amniotic, intra-articular, intrabiliary, intrabronchial, intrabursal, intracartilaginous (within a cartilage), intracaudal (within the cauda equine), intracisternal (within the cisterna magna cerebellomedularis), intracorneal (within the cornea), dental intracornal, intracoronary (within the coronary arteries), intracorporus cavernosum (within the dilatable spaces of the corporus cavernosa of the penis), intradiscal (within a disc), intraductal (within a duct of a gland), intraduodenal (within the duodenum), intradural (within or beneath the dura), intraepidermal (to the epidermis), intraesophageal (to the esophagus), intragastric (within the stomach), intragingival (within the gingivae), intraileal (within the distal portion of the small intestine), intralesional (within or introduced directly to a localized lesion), intraluminal (within a lumen of a tube), intralymphatic (within the lymph), intramedullary (within the marrow cavity of a bone), intrameningeal (within the meninges), intraocular (within the eye), intraovarian (within the ovary), intrapericardial (within the pericardium), intrapleural (within the pleura), intraprostatic (within the prostate gland), intrapulmonary (within the lungs or its bronchi), intrasinal (within the nasal or periorbital sinuses), intraspinal (within the vertebral column), intrasynovial (within the synovial cavity of a joint), intratendinous (within a tendon), intratesticular (within the testicle), intrathecal (within the cerebrospinal fluid at any level of the cerebrospinal axis), intrathoracic (within the thorax), intratubular (within the tubules of an organ), intratumor (within a tumor), intratympanic (within the aurus media), intravascular (within a vessel or vessels), intraventricular (within a ventricle), iontophoresis (by means of electric current where ions of soluble salts migrate into the tissues of the body), irrigation (to bathe or flush open wounds or body cavities), laryngeal (directly upon the larynx), nasogastric (through the nose and into the stomach), occlusive dressing technique (topical route administration that is then covered by a dressing that occludes the area), ophthalmic (to the external eye), oropharyngeal (directly to the mouth and pharynx), parenteral, percutaneous, periarticular, peridural, perineural, periodontal, rectal, respiratory (within the respiratory tract by inhaling orally or nasally for local or systemic effect), retrobulbar (behind the pons or behind the eyeball), intramyocardial (entering the myocardium), soft tissue, subarachnoid, subconjunctival, submucosal, topical, transplacental (through or across the placenta), transtracheal (through the wall of the trachea), transtympanic (across or through the tympanic cavity), ureteral (to the ureter), urethral (to the urethra), vaginal, caudal block, diagnostic, nerve block, biliary perfusion, cardiac perfusion, photopheresis or spinal. In specific embodiments, compositions can be administered in a way that allows them cross the blood-brain barrier, vascular barrier, or other epithelial barrier. In some embodiments, a formulation for a route of administration can include at least one inactive ingredient.

The polynucleotides of the present disclosure can be delivered to a cell naked. As used herein in, "naked" refers to delivering polynucleotides free from agents that promote transfection. For example, the polynucleotides delivered to the cell may contain no modifications. The naked polynucleotides can be delivered to the cell using routes of administration known in the art and described herein.

The polynucleotides of the present disclosure can be formulated, using the methods described herein. The formulations can contain polynucleotides that can be modified and/or unmodified. The formulations may further include, but are not limited to, cell penetration agents, a pharmaceutically acceptable carrier, a delivery agent, a bioerodible or biocompatible polymer, a solvent, and a sustained-release delivery depot. The formulated polynucleotides can be delivered to the cell using routes of administration known in the art and described herein.

The compositions can also be formulated for direct delivery to an organ or tissue in any of several ways in the art including, but not limited to, direct soaking or bathing, via a catheter, by gels, powder, ointments, creams, gels, lotions, and/or drops, by using substrates such as fabric or biodegradable materials coated or impregnated with the compositions, and the like.

The present disclosure encompasses the delivery of polynucleotides of the disclosure in forms suitable for parenteral and injectable administration. Liquid dosage forms for parenteral administration include, but are not limited to, pharmaceutically acceptable emulsions, microemulsions, solutions, suspensions, syrups, and/or elixirs. In addition to active ingredients, liquid dosage forms can comprise inert diluents commonly used in the art such as, for example, water or other solvents, solubilizing agents and emulsifiers such as ethyl alcohol, isopropyl alcohol, ethyl carbonate, ethyl acetate, benzyl alcohol, benzyl benzoate, propylene glycol, 1,3-butylene glycol, dimethylformamide, oils (in particular, cottonseed, groundnut, corn, germ, olive, castor, and sesame oils), glycerol, tetrahydrofurfuryl alcohol, polyethylene glycols and fatty acid esters of sorbitan, and mixtures thereof. Besides inert diluents, oral compositions can include adjuvants such as wetting agents, emulsifying and suspending agents, sweetening, flavoring, and/or perfuming agents. In certain embodiments for parenteral administration, compositions are mixed with solubilizing agents such as CREMOPHOR®, alcohols, oils, modified oils, glycols, polysorbates, cyclodextrins, polymers, and/or combinations thereof.

A pharmaceutical composition for parenteral administration can comprise at least one inactive ingredient. Any or none of the inactive ingredients used may have been approved by the US Food and Drug Administration (FDA). A non-exhaustive list of inactive ingredients for use in pharmaceutical compositions for parenteral administration includes hydrochloric acid, mannitol, nitrogen, sodium acetate, sodium chloride and sodium hydroxide.

Injectable preparations, for example, sterile injectable aqueous or oleaginous suspensions can be formulated according to the known art using suitable dispersing agents, wetting agents, and/or suspending agents. Sterile injectable preparations can be sterile injectable solutions, suspensions, and/or emulsions in nontoxic parenterally acceptable diluents and/or solvents, for example, as a solution in 1,3-butanediol. Among the acceptable vehicles and solvents that can be employed are water, Ringer's solution, U.S.P., and isotonic sodium chloride solution. Sterile, fixed oils are conventionally employed as a solvent or suspending medium. For this purpose any bland fixed oil can be employed including synthetic mono- or diglycerides. Fatty acids such as oleic acid can be used in the preparation of injectables. The sterile formulation may also comprise adjuvants such as local anesthetics, preservatives and buffering agents.

Injectable formulations can be sterilized, for example, by filtration through a bacterial-retaining filter, and/or by incorporating sterilizing agents in the form of sterile solid compositions that can be dissolved or dispersed in sterile water or other sterile injectable medium prior to use. Injectable formulations can be for direct injection into a region of a tissue, organ and/or subject. As a non-limiting example, a tissue, organ and/or subject can be directly injected a formulation by intramyocardial injection into the ischemic region. (See, e.g., Zangi et al. Nature Biotechnology 2013; the contents of which are herein incorporated by reference in its entirety).

In order to prolong the effect of an active ingredient, it is often desirable to slow the absorption of the active ingredient from subcutaneous or intramuscular injection. This can be accomplished by the use of a liquid suspension of crystalline or amorphous material with poor water solubility. The rate of absorption of the drug then depends upon its rate of dissolution which, in turn, may depend upon crystal size and crystalline form. Alternatively, delayed absorption of a parenterally administered drug form is accomplished by dissolving or suspending the drug in an oil vehicle. Injectable depot forms are made by forming microencapsule matrices of the drug in biodegradable polymers such as polylactide-polyglycolide. Depending upon the ratio of drug to polymer and the nature of the particular polymer employed, the rate of drug release can be controlled. Examples of other biodegradable polymers include poly(orthoesters) and poly(anhydrides). Depot injectable formulations are prepared by entrapping the drug in liposomes or microemulsions that are compatible with body tissues.

29. Kits and Devices a. Kits

The disclosure provides a variety of kits for conveniently and/or effectively using the claimed nucleotides of the present disclosure. Typically kits will comprise sufficient amounts and/or numbers of components to allow a user to perform multiple treatments of a subject(s) and/or to perform multiple experiments.

In one aspect, the present disclosure provides kits comprising the molecules (polynucleotides) of the disclosure.

Said kits can be for protein production, comprising a first polynucleotides comprising a translatable region. The kit may further comprise packaging and instructions and/or a delivery agent to form a formulation composition. The delivery agent can comprise a saline, a buffered solution, a lipidoid or any delivery agent disclosed herein.

In some embodiments, the buffer solution can include sodium chloride, calcium chloride, phosphate and/or EDTA. In another embodiment, the buffer solution can include, but is not limited to, saline, saline with 2 mM calcium, 5% sucrose, 5% sucrose with 2 mM calcium, 5% Mannitol, 5% Mannitol with 2 mM calcium, Ringer's lactate, sodium chloride, sodium chloride with 2 mM calcium and mannose (See, e.g., U.S. Pub. No. 20120258046; herein incorporated by reference in its entirety). In a further embodiment, the buffer solutions can be precipitated or it can be lyophilized. The amount of each component can be varied to enable consistent, reproducible higher concentration saline or simple buffer formulations. The components may also be varied in order to increase the stability of modified RNA in the buffer solution over a period of time and/or under a variety of conditions. In one aspect, the present disclosure provides kits for protein production, comprising: a polynucleotide comprising a translatable region, provided in an amount effective to produce a desired amount of a protein encoded by the translatable region when introduced into a target cell; a second polynucleotide comprising an inhibitory nucleic acid, provided in an amount effective to substantially inhibit the innate immune response of the cell; and packaging and instructions.

In one aspect, the present disclosure provides kits for protein production, comprising a polynucleotide comprising a translatable region, wherein the polynucleotide exhibits reduced degradation by a cellular nuclease, and packaging and instructions.

In one aspect, the present disclosure provides kits for protein production, comprising a polynucleotide comprising a translatable region, wherein the polynucleotide exhibits reduced degradation by a cellular nuclease, and a mammalian cell suitable for translation of the translatable region of the first nucleic acid.

b. Devices

The present disclosure provides for devices that may incorporate polynucleotides that encode polypeptides of interest. These devices contain in a stable formulation the reagents to synthesize a polynucleotide in a formulation available to be immediately delivered to a subject in need thereof, such as a human patient Devices for administration can be employed to deliver the polynucleotides of the present disclosure according to single, multi- or split-dosing regimens taught herein. Such devices are taught in, for example, International Application Publ. No. WO2013151666, the contents of which are incorporated herein by reference in their entirety.

Method and devices known in the art for multi-administration to cells, organs and tissues are contemplated for use in conjunction with the methods and compositions disclosed herein as embodiments of the present disclosure. These include, for example, those methods and devices having multiple needles, hybrid devices employing for example lumens or catheters as well as devices utilizing heat, electric current or radiation driven mechanisms.

According to the present disclosure, these multi-administration devices can be utilized to deliver the single, multi- or split doses contemplated herein. Such devices are taught for example in, International Application Publ. No. WO2013151666, the contents of which are incorporated herein by reference in their entirety.

In some embodiments, the polynucleotide is administered subcutaneously or intramuscularly via at least 3 needles to three different, optionally adjacent, sites simultaneously, or within a 60 minutes period (e.g., administration to 4, 5, 6, 7, 8, 9, or 10 sites simultaneously or within a 60 minute period).

c. Methods and Devices Utilizing Catheters and/or Lumens

Methods and devices using catheters and lumens can be employed to administer the polynucleotides of the present disclosure on a single, multi- or split dosing schedule. Such methods and devices are described in International Application Publication No. WO2013151666, the contents of which are incorporated herein by reference in their entirety.

d. Methods and Devices Utilizing Electrical Current

Methods and devices utilizing electric current can be employed to deliver the polynucleotides of the present disclosure according to the single, multi- or split dosing regimens taught herein. Such methods and devices are described in International Application Publication No. WO2013151666, the contents of which are incorporated herein by reference in their entirety.

30. Definitions

In order that the present disclosure can be more readily understood, certain terms are first defined. As used in this application, except as otherwise expressly provided herein, each of the following terms shall have the meaning set forth below. Additional definitions are set forth throughout the application.

The disclosure includes embodiments in which exactly one member of the group is present in, employed in, or otherwise relevant to a given product or process. The disclosure includes embodiments in which more than one, or all of the group members are present in, employed in, or otherwise relevant to a given product or process.

In this specification and the appended claims, the singular forms "a", "an" and "the" include plural referents unless the context clearly dictates otherwise. The terms "a" (or "an"), as well as the terms "one or more," and "at least one" can be used interchangeably herein. In certain aspects, the term "a" or "an" means "single." In other aspects, the term "a" or "an" includes "two or more" or "multiple."

Furthermore, "and/or" where used herein is to be taken as specific disclosure of each of the two specified features or components with or without the other. Thus, the term "and/or" as used in a phrase such as "A and/or B" herein is intended to include "A and B," "A or B," "A" (alone), and "B" (alone) Likewise, the term "and/or" as used in a phrase such as "A, B, and/or C" is intended to encompass each of the following aspects: A, B, and C; A, B, or C; A or C; A or B; B or C; A and C; A and B; B and C; A (alone); B (alone); and C (alone).

Unless defined otherwise, all technical and scientific terms used herein have the same meaning as commonly understood by one of ordinary skill in the art to which this disclosure is related. For example, the Concise Dictionary of Biomedicine and Molecular Biology, Juo, Pei-Show, 2nd ed., 2002, CRC Press; The Dictionary of Cell and Molecular Biology, 3rd ed., 1999, Academic Press; and the Oxford Dictionary Of Biochemistry And Molecular Biology, Revised, 2000, Oxford University Press, provide one of skill with a general dictionary of many of the terms used in this disclosure.

Wherever aspects are described herein with the language "comprising," otherwise analogous aspects described in terms of "consisting of" and/or "consisting essentially of" are also provided. Units, prefixes, and symbols are denoted in their Système International de Unites (SI) accepted form. Numeric ranges are inclusive of the numbers defining the range. Where a range of values is recited, it is to be understood that each intervening integer value, and each fraction thereof, between the recited upper and lower limits of that range is also specifically disclosed, along with each subrange between such values. The upper and lower limits of any range can independently be included in or excluded from the range, and each range where either, neither or both limits are included is also encompassed within the disclosure. Where a value is explicitly recited, it is to be understood that values which are about the same quantity or amount as the recited value are also within the scope of the disclosure. Where a combination is disclosed, each subcombination of the elements of that combination is also specifically disclosed and is within the scope of the disclosure. Conversely, where different elements or groups of elements are individually disclosed, combinations thereof are also disclosed. Where any element of a disclosure is disclosed as having a plurality of alternatives, examples of that disclosure in which each alternative is excluded singly or in any combination with the other alternatives are also hereby disclosed; more than one element of a disclosure can have such exclusions, and all combinations of elements having such exclusions are hereby disclosed.

Nucleotides are referred to by their commonly accepted single-letter codes. Unless otherwise indicated, nucleic acids are written left to right in 5' to 3' orientation. Nucleobases are referred to herein by their commonly known one-letter symbols recommended by the IUPAC-IUB Biochemical Nomenclature Commission. Accordingly, A represents adenine, C represents cytosine, G represents guanine, T represents thymine, U represents uracil.

Amino acids are referred to herein by either their commonly known three letter symbols or by the one-letter symbols recommended by the IUPAC-IUB Biochemical Nomenclature Commission. Unless otherwise indicated, amino acid sequences are written left to right in amino to carboxy orientation.

About: The term "about" as used in connection with a numerical value throughout the specification and the claims denotes an interval of accuracy, familiar and acceptable to a person skilled in the art. In general, such interval of accuracy is ±10%.

Where ranges are given, endpoints are included. Furthermore, unless otherwise indicated or otherwise evident from the context and understanding of one of ordinary skill in the art, values that are expressed as ranges can assume any specific value or subrange within the stated ranges in different embodiments of the disclosure, to the tenth of the unit of the lower limit of the range, unless the context clearly dictates otherwise.

Administered in combination: As used herein, the term "administered in combination" or "combined administration" means that two or more agents are administered to a subject at the same time or within an interval such that there can be an overlap of an effect of each agent on the patient. In some embodiments, they are administered within about 60, 30, 15, 10, 5, or 1 minute of one another. In some embodiments, the administrations of the agents are spaced sufficiently closely together such that a combinatorial (e.g., a synergistic) effect is achieved.

Amino acid substitution: The term "amino acid substitution" refers to replacing an amino acid residue present in a parent or reference sequence (e.g., a wild type IL-12 sequence) with another amino acid residue. An amino acid can be substituted in a parent or reference sequence (e.g., a wild type IL-12 polypeptide sequence), for example, via chemical peptide synthesis or through recombinant methods known in the art. Accordingly, a reference to a "substitution at position X" refers to the substitution of an amino acid present at position X with an alternative amino acid residue. In some aspects, substitution patterns can be described according to the schema AnY, wherein A is the single letter code corresponding to the amino acid naturally or originally present at position n, and Y is the substituting amino acid residue. In other aspects, substitution patterns can be described according to the schema An(YZ), wherein A is the single letter code corresponding to the amino acid residue substituting the amino acid naturally or originally present at position X, and Y and Z are alternative substituting amino acid residue, i.e., In the context of the present disclosure, substitutions (even when they referred to as amino acid substitution) are conducted at the nucleic acid level, i.e., substituting an amino acid residue with an alternative amino acid residue is conducted by substituting the codon encoding the first amino acid with a codon encoding the second amino acid.

Animal: As used herein, the term "animal" refers to any member of the animal kingdom. In some embodiments, "animal" refers to humans at any stage of development. In some embodiments, "animal" refers to non-human animals at any stage of development. In certain embodiments, the non-human animal is a mammal (e.g., a rodent, a mouse, a rat, a rabbit, a monkey, a dog, a cat, a sheep, cattle, a primate, or a pig). In some embodiments, animals include, but are not limited to, mammals, birds, reptiles, amphibians, fish, and worms. In some embodiments, the animal is a transgenic animal, genetically-engineered animal, or a clone.

Approximately: As used herein, the term "approximately," as applied to one or more values of interest, refers to a value that is similar to a stated reference value. In certain embodiments, the term "approximately" refers to a range of values that fall within 25%, 20%, 19%, 18%, 17%, 16%, 15%, 14%, 13%, 12%, 11%, 10%, 9%, 8%, 7%, 6%, 5%, 4%, 3%, 2%, 1%, or less in either direction (greater than or less than) of the stated reference value unless otherwise stated or otherwise evident from the context (except where such number would exceed 100% of a possible value).

Associated with: As used herein with respect to a disease, the term "associated with" means that the symptom, measurement, characteristic, or status in question is linked to the diagnosis, development, presence, or progression of that disease. As association may, but need not, be causatively linked to the disease. For example, symptoms, sequelae, or any effects causing a decrease in the quality of life of a patient of cancer are considered associated with cancer and in some embodiments of the present disclosure can be treated, ameliorated, or prevented by administering the polynucleotides of the present disclosure to a subject in need thereof.

When used with respect to two or more moieties, the terms "associated with," "conjugated," "linked," "attached," and "tethered," when used with respect to two or more moieties, means that the moieties are physically associated or connected with one another, either directly or via one or more additional moieties that serves as a linking agent, to form a structure that is sufficiently stable so that the moieties remain physically associated under the conditions in which the structure is used, e.g., physiological conditions. An "association" need not be strictly through direct covalent chemical bonding. It may also suggest ionic or hydrogen bonding or a hybridization based connectivity sufficiently stable such that the "associated" entities remain physically associated.

Bifunctional: As used herein, the term "bifunctional" refers to any substance, molecule or moiety that is capable of or maintains at least two functions. The functions may affect the same outcome or a different outcome. The structure that produces the function can be the same or different. For example, bifunctional modified RNAs of the present disclosure may encode an IL-12 peptide (a first function) while those nucleosides that comprise the encoding RNA are, in and of themselves, capable of extending the half-life of the RNA (second function). In this example, delivery of the bifunctional modified RNA to a subject suffering from a protein deficiency would produce not only a peptide or protein molecule that may ameliorate or treat a disease or conditions, but would also maintain a population modified RNA present in the subject for a prolonged period of time. In other aspects, a bifunctionally modified mRNA can be a chimeric molecule comprising, for example, an RNA encoding an IL-12 peptide (a first function) and a second protein either fused to first protein or co-expressed with the first protein.

Biocompatible: As used herein, the term "biocompatible" means compatible with living cells, tissues, organs or systems posing little to no risk of injury, toxicity or rejection by the immune system.

Biodegradable: As used herein, the term "biodegradable" means capable of being broken down into innocuous products by the action of living things.

Biologically active: As used herein, the phrase "biologically active" refers to a characteristic of any substance that has activity in a biological system and/or organism. For instance, a substance that, when administered to an organism, has a biological effect on that organism, is considered to be biologically active. In particular embodiments, a polynucleotide of the present disclosure can be considered biologically active if even a portion of the polynucleotide is biologically active or mimics an activity considered biologically relevant.

Chimera: As used herein, "chimera" is an entity having two or more incongruous or heterogeneous parts or regions. For example, a chimeric molecule can comprise a first part comprising an IL-12B polypeptide, IL-12A polypeptide, or both IL-12B and IL-12A polypeptides, and a second part (e.g., genetically fused or linked to the first part) comprising a membrane domain. A chimera can also include a tethered IL-12 polypeptide as disclosed herein further comprising a second therapeutic protein (e.g., a protein with a distinct enzymatic activity, an antigen binding moiety, or a moiety capable of extending the plasma half-life of IL-12, for example, an Fc region of an antibody).

Sequence Optimization: The term "sequence optimization" refers to a process or series of processes by which nucleobases in a reference nucleic acid sequence are replaced with alternative nucleobases, resulting in a nucleic acid sequence with improved properties, e.g., improved protein expression or decreased immunogenicity.

In general, the goal in sequence optimization is to produce a synonymous nucleotide sequence than encodes the same polypeptide sequence encoded by the reference nucleotide sequence. Thus, there are no amino acid substitutions (as a result of codon optimization) in the polypeptide encoded by the codon optimized nucleotide sequence with respect to the polypeptide encoded by the reference nucleotide sequence.

Codon substitution: The terms "codon substitution" or "codon replacement" in the context of sequence optimization refer to replacing a codon present in a reference nucleic acid sequence with another codon. A codon can be substituted in a reference nucleic acid sequence, for example, via chemical peptide synthesis or through recombinant methods known in the art. Accordingly, references to a "substitution" or "replacement" at a certain location in a nucleic acid sequence (e.g., an mRNA) or within a certain region or subsequence of a nucleic acid sequence (e.g., an mRNA) refer to the substitution of a codon at such location or region with an alternative codon. As used herein, the terms "coding region" and "region encoding" and grammatical variants thereof, refer to an Open Reading Frame (ORF) in a polynucleotide that upon expression yields a polypeptide or protein.

Compound: As used herein, the term "compound," is meant to include all stereoisomers and isotopes of the structure depicted. As used herein, the term "stereoisomer" means any geometric isomer (e.g., cis- and trans-isomer), enantiomer, or diastereomer of a compound. The present disclosure encompasses any and all stereoisomers of the compounds described herein, including stereomerically pure forms (e.g., geometrically pure, enantiomerically pure, or diastereomerically pure) and enantiomeric and stereoisomeric mixtures, e.g., racemates. Enantiomeric and stereomeric mixtures of compounds and means of resolving them into their component enantiomers or stereoisomers are well-known. "Isotopes" refers to atoms having the same atomic number but different mass numbers resulting from a different number of neutrons in the nuclei. For example, isotopes of hydrogen include tritium and deuterium. Further, a compound, salt, or complex of the present disclosure can be prepared in combination with solvent or water molecules to form solvates and hydrates by routine methods.

Contacting: As used herein, the term "contacting" means establishing a physical connection between two or more entities. For example, contacting a mammalian cell with a nanoparticle composition means that the mammalian cell and a nanoparticle are made to share a physical connection. Methods of contacting cells with external entities both in vivo and ex vivo are well known in the biological arts. For example, contacting a nanoparticle composition and a mammalian cell disposed within a mammal may be performed by varied routes of administration (e.g., intravenous, intramuscular, intradermal, and subcutaneous) and may involve varied amounts of nanoparticle compositions. Moreover, more than one mammalian cell may be contacted by a nanoparticle composition.

Conservative amino acid substitution: A "conservative amino acid substitution" is one in which the amino acid residue in a protein sequence is replaced with an amino acid residue having a similar side chain. Families of amino acid residues having similar side chains have been defined in the art, including basic side chains (e.g., lysine, arginine, or histidine), acidic side chains (e.g., aspartic acid or glutamic acid), uncharged polar side chains (e.g., glycine, asparagine, glutamine, serine, threonine, tyrosine, or cysteine), nonpolar side chains (e.g., alanine, valine, leucine, isoleucine, proline, phenylalanine, methionine, or tryptophan), beta-branched side chains (e.g., threonine, valine, isoleucine) and aromatic side chains (e.g., tyrosine, phenylalanine, tryptophan, or histidine). Thus, if an amino acid in a polypeptide is replaced with another amino acid from the same side chain family, the amino acid substitution is considered to be conservative. In another aspect, a string of amino acids can be conservatively replaced with a structurally similar string that differs in order and/or composition of side chain family members.

Non-conservative amino acid substitution: Non-conservative amino acid substitutions include those in which (i) a residue having an electropositive side chain (e.g., Arg, His or Lys) is substituted for, or by, an electronegative residue (e.g., Glu or Asp), (ii) a hydrophilic residue (e.g., Ser or Thr) is substituted for, or by, a hydrophobic residue (e.g., Ala, Leu, Ile, Phe or Val), (iii) a cysteine or proline is substituted for, or by, any other residue, or (iv) a residue having a bulky hydrophobic or aromatic side chain (e.g., Val, His, Be or Trp) is substituted for, or by, one having a smaller side chain (e.g., Ala or Ser) or no side chain (e.g., Gly).

Other amino acid substitutions can be readily identified by workers of ordinary skill. For example, for the amino acid alanine, a substitution can be taken from any one of D-alanine, glycine, beta-alanine, L-cysteine and D-cysteine. For lysine, a replacement can be any one of D-lysine, arginine, D-arginine, homo-arginine, methionine, D-methionine, ornithine, or D-ornithine. Generally, substitutions in functionally important regions that can be expected to induce changes in the properties of isolated polypeptides are those in which (i) a polar residue, e.g., serine or threonine, is substituted for (or by) a hydrophobic residue, e.g., leucine, isoleucine, phenylalanine, or alanine; (ii) a cysteine residue is substituted for (or by) any other residue; (iii) a residue having an electropositive side chain, e.g., lysine, arginine or histidine, is substituted for (or by) a residue having an electronegative side chain, e.g., glutamic acid or aspartic acid; or (iv) a residue having a bulky side chain, e.g., phenylalanine, is substituted for (or by) one not having such a side chain, e.g., glycine. The likelihood that one of the foregoing non-conservative substitutions can alter functional properties of the protein is also correlated to the position of the substitution with respect to functionally important regions of the protein: some non-conservative substitutions can accordingly have little or no effect on biological properties.

Conserved: As used herein, the term "conserved" refers to nucleotides or amino acid residues of a polynucleotide sequence or polypeptide sequence, respectively, that are those that occur unaltered in the same position of two or more sequences being compared. Nucleotides or amino acids that are relatively conserved are those that are conserved amongst more related sequences than nucleotides or amino acids appearing elsewhere in the sequences.

In some embodiments, two or more sequences are said to be "completely conserved" if they are 100% identical to one another. In some embodiments, two or more sequences are said to be "highly conserved" if they are at least 70% identical, at least 80% identical, at least 90% identical, or at least 95% identical to one another. In some embodiments, two or more sequences are said to be "highly conserved" if they are about 70% identical, about 80% identical, about 90% identical, about 95%, about 98%, or about 99% identical to one another. In some embodiments, two or more sequences are said to be "conserved" if they are at least 30% identical, at least 40% identical, at least 50% identical, at least 60% identical, at least 70% identical, at least 80% identical, at least 90% identical, or at least 95% identical to one another. In some embodiments, two or more sequences are said to be "conserved" if they are about 30% identical, about 40% identical, about 50% identical, about 60% identical, about 70% identical, about 80% identical, about 90% identical, about 95% identical, about 98% identical, or about 99% identical to one another. Conservation of sequence may apply to the entire length of a polynucleotide or polypeptide or may apply to a portion, region or feature thereof.

Controlled Release: As used herein, the term "controlled release" refers to a pharmaceutical composition or compound release profile that conforms to a particular pattern of release to effect a therapeutic outcome.

Cyclic or Cyclized: As used herein, the term "cyclic" refers to the presence of a continuous loop. Cyclic molecules need not be circular, only joined to form an unbroken chain of subunits. Cyclic molecules such as the engineered RNA or mRNA of the present disclosure can be single units or multimers or comprise one or more components of a complex or higher order structure.

Cytotoxic: As used herein, "cytotoxic" refers to killing or causing injurious, toxic, or deadly effect on a cell (e.g., a mammalian cell (e.g., a human cell)), bacterium, virus, fungus, protozoan, parasite, prion, or a combination thereof.

Delivering: As used herein, the term "delivering" means providing an entity to a destination. For example, delivering a polynucleotide to a subject may involve administering a nanoparticle composition including the polynucleotide to the subject (e.g., by an intravenous, intramuscular, intradermal, or subcutaneous route). Administration of a nanoparticle composition to a mammal or mammalian cell may involve contacting one or more cells with the nanoparticle composition.

Delivery Agent: As used herein, "delivery agent" refers to any substance that facilitates, at least in part, the in vivo, in vitro, or ex vivo delivery of a polynucleotide to targeted cells.

Destabilized: As used herein, the term "destable," "destabilize," or "destabilizing region" means a region or molecule that is less stable than a starting, wild-type or native form of the same region or molecule.

Diastereomer: As used herein, the term "diastereomer," means stereoisomers that are not mirror images of one another and are non-superimposable on one another.

Digest: As used herein, the term "digest" means to break apart into smaller pieces or components. When referring to polypeptides or proteins, digestion results in the production of peptides.

Distal: As used herein, the term "distal" means situated away from the center or away from a point or region of interest.

Domain: As used herein, when referring to polypeptides, the term "domain" refers to a motif of a polypeptide having one or more identifiable structural or functional characteristics or properties (e.g., binding capacity, serving as a site for protein-protein interactions).

Dosing regimen: As used herein, a "dosing regimen" or a "dosing regimen" is a schedule of administration or physician determined regimen of treatment, prophylaxis, or palliative care.

Effective Amount: As used herein, the term "effective amount" of an agent is that amount sufficient to effect beneficial or desired results, for example, clinical results, and, as such, an "effective amount" depends upon the context in which it is being applied. For example, in the context of administering an agent that treats a protein deficiency (e.g., an IL-12 deficiency), an effective amount of an agent is, for example, an amount of mRNA expressing sufficient PBGF to ameliorate, reduce, eliminate, or prevent the symptoms associated with the IL-12 deficiency, as compared to the severity of the symptom observed without administration of the agent. The term "effective amount" can be used interchangeably with "effective dose," "therapeutically effective amount," or "therapeutically effective dose."

Enantiomer: As used herein, the term "enantiomer" means each individual optically active form of a compound of the disclosure, having an optical purity or enantiomeric excess (as determined by methods standard in the art) of at least 80% (i.e., at least 90% of one enantiomer and at most 10% of the other enantiomer), at least 90%, or at least 98%.

Encapsulate: As used herein, the term "encapsulate" means to enclose, surround or encase.

Encapsulation Efficiency: As used herein, "encapsulation efficiency" refers to the amount of a polynucleotide that becomes part of a nanoparticle composition, relative to the initial total amount of polynucleotide used in the preparation of a nanoparticle composition. For example, if 97 mg of polynucleotide are encapsulated in a nanoparticle composition out of a total 100 mg of polynucleotide initially provided to the composition, the encapsulation efficiency may be given as 97%. As used herein, "encapsulation" may refer to complete, substantial, or partial enclosure, confinement, surrounding, or encasement.

Encoded protein cleavage signal: As used herein, "encoded protein cleavage signal" refers to the nucleotide sequence that encodes a protein cleavage signal.

Engineered: As used herein, embodiments of the disclosure are "engineered" when they are designed to have a feature or property, whether structural or chemical, that varies from a starting point, wild type or native molecule.

Enhanced Delivery: As used herein, the term "enhanced delivery" means delivery of more (e.g., at least 1.5 fold more, at least 2-fold more, at least 3-fold more, at least 4-fold more, at least 5-fold more, at least 6-fold more, at least 7-fold more, at least 8-fold more, at least 9-fold more, at least 10-fold more) of a polynucleotide by a nanoparticle to a target tissue of interest (e.g., mammalian liver) compared to the level of delivery of a polynucleotide by a control nanoparticle to a target tissue of interest (e.g., MC3, KC2, or DLinDMA). The level of delivery of a nanoparticle to a particular tissue may be measured by comparing the amount of protein produced in a tissue to the weight of said tissue, comparing the amount of polynucleotide in a tissue to the weight of said tissue, comparing the amount of protein produced in a tissue to the amount of total protein in said tissue, or comparing the amount of polynucleotide in a tissue to the amount of total polynucleotide in said tissue. It will be understood that the enhanced delivery of a nanoparticle to a target tissue need not be determined in a subject being treated, it may be determined in a surrogate such as an animal model (e.g., a rat model).

Exosome: As used herein, "exosome" is a vesicle secreted by mammalian cells or a complex involved in RNA degradation.

Expression: As used herein, "expression" of a nucleic acid sequence refers to one or more of the following events: (1) production of an mRNA template from a DNA sequence (e.g., by transcription); (2) processing of an mRNA transcript (e.g., by splicing, editing, 5' cap formation, and/or 3' end processing); (3) translation of an mRNA into a polypeptide or protein; and (4) post-translational modification of a polypeptide or protein.

Ex Vivo: As used herein, the term "ex vivo" refers to events that occur outside of an organism (e.g., animal, plant, or microbe or cell or tissue thereof). Ex vivo events may take place in an environment minimally altered from a natural (e.g., in vivo) environment.

Feature: As used herein, a "feature" refers to a characteristic, a property, or a distinctive element. When referring to polypeptides, "features" are defined as distinct amino acid sequence-based components of a molecule. Features of the polypeptides encoded by the polynucleotides of the present disclosure include surface manifestations, local conformational shape, folds, loops, half-loops, domains, half-domains, sites, termini or any combination thereof.

Formulation: As used herein, a "formulation" includes at least a polynucleotide and one or more of a carrier, an excipient, and a delivery agent.

Fragment: A "fragment," as used herein, refers to a portion. For example, fragments of proteins can comprise polypeptides obtained by digesting full-length protein isolated from cultured cells. In some embodiments, a fragment is a subsequence of a full length protein (e.g., IL-12 and/or a membrane domain) wherein N-terminal, and/or C-terminal, and/or internal subsequences have been deleted. In some preferred aspects of the present disclosure, the fragments of a protein of the present disclosure are functional fragments.

Functional: As used herein, a "functional" biological molecule is a biological molecule in a form in which it exhibits a property and/or activity by which it is characterized. Thus, a functional fragment of a polynucleotide of the present disclosure is a polynucleotide capable of expressing a functional IL-12 and/or membrane domain fragment. As used herein, a functional fragment of IL-12 refers to a fragment of wild type IL-12 (i.e., a fragment of any of its naturally occurring isoforms), or a mutant or variant thereof, wherein the fragment retains a least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, or at least about 95% of the biological activity of the corresponding full length protein. As used herein, a functional fragment of a membrane domain is a fragment of a wild type membrane domain, or a mutant or variant thereof, wherein the fragment is capable of tethering an IL-12 polypeptide to a cell membrane.

Helper Lipid: As used herein, the term "helper lipid" refers to a compound or molecule that includes a lipidic moiety (for insertion into a lipid layer, e.g., lipid bilayer) and a polar moiety (for interaction with physiologic solution at the surface of the lipid layer). Typically the helper lipid is a phospholipid. A function of the helper lipid is to "complement" the amino lipid and increase the fusogenicity of the bilayer and/or to help facilitate endosomal escape, e.g., of nucleic acid delivered to cells. Helper lipids are also believed to be a key structural component to the surface of the LNP.

Homology: As used herein, the term "homology" refers to the overall relatedness between polymeric molecules, e.g. between nucleic acid molecules (e.g. DNA molecules and/or RNA molecules) and/or between polypeptide molecules. Generally, the term "homology" implies an evolutionary relationship between two molecules. Thus, two molecules that are homologous will have a common evolutionary ancestor. In the context of the present disclosure, the term homology encompasses both to identity and similarity.

In some embodiments, polymeric molecules are considered to be "homologous" to one another if at least 25%, 30%, 35%, 40%, 45%, 50%, 55%, 60%, 65%, 70%, 75%, 80%, 85%, 90%, 95%, or 99% of the monomers in the molecule are identical (exactly the same monomer) or are similar (conservative substitutions). The term "homologous" necessarily refers to a comparison between at least two sequences (polynucleotide or polypeptide sequences).

Identity: As used herein, the term "identity" refers to the overall monomer conservation between polymeric molecules, e.g., between polynucleotide molecules (e.g. DNA molecules and/or RNA molecules) and/or between polypeptide molecules. Calculation of the percent identity of two polynucleotide sequences, for example, can be performed by aligning the two sequences for optimal comparison purposes (e.g., gaps can be introduced in one or both of a first and a second nucleic acid sequences for optimal alignment and non-identical sequences can be disregarded for comparison purposes). In certain embodiments, the length of a sequence aligned for comparison purposes is at least 30%, at least 40%, at least 50%, at least 60%, at least 70%, at least 80%, at least 90%, at least 95%, or 100% of the length of the reference sequence. The nucleotides at corresponding nucleotide positions are then compared. When a position in the first sequence is occupied by the same nucleotide as the corresponding position in the second sequence, then the molecules are identical at that position. The percent identity between the two sequences is a function of the number of identical positions shared by the sequences, taking into account the number of gaps, and the length of each gap, which needs to be introduced for optimal alignment of the two sequences. The comparison of sequences and determination of percent identity between two sequences can be accomplished using a mathematical algorithm. When comparing DNA and RNA, thymine (T) and uracil (U) can be considered equivalent.

Suitable software programs are available from various sources, and for alignment of both protein and nucleotide sequences. One suitable program to determine percent sequence identity is bl2seq, part of the BLAST suite of program available from the U.S. government's National Center for Biotechnology Information BLAST web site (blast.ncbi.nlm.nih.gov). Bl2seq performs a comparison between two sequences using either the BLASTN or BLASTP algorithm. BLASTN is used to compare nucleic acid sequences, while BLASTP is used to compare amino acid sequences. Other suitable programs are, e.g., Needle, Stretcher, Water, or Matcher, part of the EMBOSS suite of bioinformatics programs and also available from the European Bioinformatics Institute (EBI) at www.ebi.ac.uk/Tools/psa.

Sequence alignments can be conducted using methods known in the art such as MAFFT, Clustal (ClustalW, Clustal X or Clustal Omega), MUSCLE, etc.

Different regions within a single polynucleotide or polypeptide target sequence that aligns with a polynucleotide or polypeptide reference sequence can each have their own percent sequence identity. It is noted that the percent sequence identity value is rounded to the nearest tenth. For example, 80.11, 80.12, 80.13, and 80.14 are rounded down to 80.1, while 80.15, 80.16, 80.17, 80.18, and 80.19 are rounded up to 80.2. It also is noted that the length value will always be an integer.

In certain aspects, the percentage identity "% ID" of a first amino acid sequence (or nucleic acid sequence) to a second amino acid sequence (or nucleic acid sequence) is calculated as % ID=100×(Y/Z), where Y is the number of amino acid residues (or nucleobases) scored as identical matches in the alignment of the first and second sequences (as aligned by visual inspection or a particular sequence alignment program) and Z is the total number of residues in the second sequence. If the length of a first sequence is longer than the second sequence, the percent identity of the first sequence to the second sequence will be higher than the percent identity of the second sequence to the first sequence.

One skilled in the art will appreciate that the generation of a sequence alignment for the calculation of a percent sequence identity is not limited to binary sequence-sequence comparisons exclusively driven by primary sequence data. It will also be appreciated that sequence alignments can be generated by integrating sequence data with data from heterogeneous sources such as structural data (e.g., crystallographic protein structures), functional data (e.g., location of mutations), or phylogenetic data. A suitable program that integrates heterogeneous data to generate a multiple sequence alignment is T-Coffee, available at www.tcoffee.org, and alternatively available, e.g., from the EBI. It will also be appreciated that the final alignment used to calculate percent sequence identity can be curated either automatically or manually.

Immune response: The term "immune response" refers to the action of, for example, lymphocytes, antigen presenting cells, phagocytic cells, granulocytes, and soluble macromolecules produced by the above cells or the liver (including antibodies, cytokines, and complement) that results in selective damage to, destruction of, or elimination from the human body of invading pathogens, cells or tissues infected with pathogens, cancerous cells, or, in cases of autoimmunity or pathological inflammation, normal human cells or tissues. In some cases, the administration of a nanoparticle comprising a lipid component and an encapsulated therapeutic agent can trigger an immune response, which can be caused by (i) the encapsulated therapeutic agent (e.g., an mRNA), (ii) the expression product of such encapsulated therapeutic agent (e.g., a polypeptide encoded by the mRNA), (iii) the lipid component of the nanoparticle, or (iv) a combination thereof.

Inflammatory response: "Inflammatory response" refers to immune responses involving specific and non-specific defense systems. A specific defense system reaction is a specific immune system reaction to an antigen. Examples of specific defense system reactions include antibody responses. A non-specific defense system reaction is an inflammatory response mediated by leukocytes generally incapable of immunological memory, e.g., macrophages, eosinophils and neutrophils. In some aspects, an immune response includes the secretion of inflammatory cytokines, resulting in elevated inflammatory cytokine levels.

Inflammatory cytokines: The term "inflammatory cytokine" refers to cytokines that are elevated in an inflammatory response. Examples of inflammatory cytokines include interleukin-6 (IL-6), CXCL1 (chemokine (C-X-C motif) ligand 1; also known as GROα, interferon-γ (IFNγ), tumor necrosis factor α (TNFα), interferon γ-induced protein 10 (IP-10), or granulocyte-colony stimulating factor (G-CSF). The term inflammatory cytokines includes also other cytokines associated with inflammatory responses known in the art, e.g., interleukin-1 (IL-1), interleukin-8 (IL-8), interleukin-12 (IL-12), interleukin-13 (11-13), interferon α (IFN-α), etc.

In Vitro: As used herein, the term "in vitro" refers to events that occur in an artificial environment, e.g., in a test tube or reaction vessel, in cell culture, in a Petri dish, etc., rather than within an organism (e.g., animal, plant, or microbe).

In Vivo: As used herein, the term "in vivo" refers to events that occur within an organism (e.g., animal, plant, or microbe or cell or tissue thereof).

Insertional and deletional variants: "Insertional variants" when referring to polypeptides are those with one or more amino acids inserted immediately adjacent to an amino acid at a particular position in a native or starting sequence. "Immediately adjacent" to an amino acid means connected to either the alpha-carboxy or alpha-amino functional group of the amino acid. "Deletional variants" when referring to polypeptides are those with one or more amino acids in the native or starting amino acid sequence removed. Ordinarily, deletional variants will have one or more amino acids deleted in a particular region of the molecule.

Intact: As used herein, in the context of a polypeptide, the term "intact" means retaining an amino acid corresponding to the wild type protein, e.g., not mutating or substituting the wild type amino acid. Conversely, in the context of a nucleic acid, the term "intact" means retaining a nucleobase corresponding to the wild type nucleic acid, e.g., not mutating or substituting the wild type nucleobase.

Intracellular domain: As used herein, the terms "intracellular domain", "IC" and "ICD" refer to the region of a polypeptide located inside a cell. In some embodiments, an intracellular domain transmits a signal to the cell. In some embodiments, the tethered IL-12 polypeptides encoded by the polynucleotides (e.g., mRNA) described herein, comprise an intracellular domain that transmits a signal to the cell. In some embodiments, the tethered IL-12 polypeptides encoded by the polynucleotides (e.g., mRNA) described herein, comprise an intracellular domain that does not transmit a signal to the cell.

Ionizable amino lipid: The term "ionizable amino lipid" includes those lipids having one, two, three, or more fatty acid or fatty alkyl chains and a pH-titratable amino head group (e.g., an alkylamino or dialkylamino head group). An ionizable amino lipid is typically protonated (i.e., positively charged) at a pH below the pKa of the amino head group and is substantially not charged at a pH above the pKa. Such ionizable amino lipids include, but are not limited to DLin-MC3-DMA (MC3) and (13Z,165Z)—N,N-dimethyl-3-nonydocosa-13-16-dien-1-amine (L608).

Isolated: As used herein, the term "isolated" refers to a substance or entity that has been separated from at least some of the components with which it was associated (whether in nature or in an experimental setting). Isolated substances (e.g., polynucleotides or polypeptides) can have varying levels of purity in reference to the substances from which they have been isolated. Isolated substances and/or entities can be separated from at least about 10%, about 20%, about 30%, about 40%, about 50%, about 60%, about 70%, about 80%, about 90%, or more of the other components with which they were initially associated. In some embodiments, isolated substances are more than about 80%, about 85%, about 90%, about 91%, about 92%, about 93%, about 94%, about 95%, about 96%, about 97%, about 98%, about 99%, or more than about 99% pure. As used herein, a substance is "pure" if it is substantially free of other components.

Substantially isolated: By "substantially isolated" is meant that the compound is substantially separated from the environment in which it was formed or detected. Partial separation can include, for example, a composition enriched in the compound of the present disclosure. Substantial separation can include compositions containing at least about 50%, at least about 60%, at least about 70%, at least about 80%, at least about 90%, at least about 95%, at least about 97%, or at least about 99% by weight of the compound of the present disclosure, or salt thereof.

A polynucleotide, vector, polypeptide, cell, or any composition disclosed herein which is "isolated" is a polynucleotide, vector, polypeptide, cell, or composition which is in a form not found in nature. Isolated polynucleotides, vectors, polypeptides, or compositions include those which have been purified to a degree that they are no longer in a form in which they are found in nature. In some aspects, a polynucleotide, vector, polypeptide, or composition which is isolated is substantially pure.

Isomer: As used herein, the term "isomer" means any tautomer, stereoisomer, enantiomer, or diastereomer of any compound of the disclosure. It is recognized that the compounds of the disclosure can have one or more chiral centers and/or double bonds and, therefore, exist as stereoisomers, such as double-bond isomers (i.e., geometric E/Z isomers) or diastereomers (e.g., enantiomers (i.e., (+) or (−)) or cis/trans isomers). According to the disclosure, the chemical structures depicted herein, and therefore the compounds of the disclosure, encompass all of the corresponding stereoisomers, that is, both the stereomerically pure form (e.g., geometrically pure, enantiomerically pure, or diastereomerically pure) and enantiomeric and stereoisomeric mixtures, e.g., racemates. Enantiomeric and stereoisomeric mixtures of compounds of the disclosure can typically be resolved into their component enantiomers or stereoisomers by well-known methods, such as chiral-phase gas chromatography, chiral-phase high performance liquid chromatography, crystallizing the compound as a chiral salt complex, or crystallizing the compound in a chiral solvent. Enantiomers and stereoisomers can also be obtained from stereomerically or enantiomerically pure intermediates, reagents, and catalysts by well-known asymmetric synthetic methods.

Linker: As used herein, a "linker" (including a membrane linker, a subunit linker, and a heterologous polypeptide linker as referred to herein) refers to a group of atoms, e.g., 10-1,000 atoms, and can be comprised of the atoms or groups such as, but not limited to, carbon, amino, alkylamino, oxygen, sulfur, sulfoxide, sulfonyl, carbonyl, and imine. The linker can be attached to a modified nucleoside or nucleotide on the nucleobase or sugar moiety at a first end, and to a payload, e.g., a detectable or therapeutic agent, at a second end. The linker can be of sufficient length as to not interfere with incorporation into a nucleic acid sequence. The linker can be used for any useful purpose, such as to form polynucleotide multimers (e.g., through linkage of two or more chimeric polynucleotides molecules or IVT polynucleotides) or polynucleotides conjugates, as well as to administer a payload, as described herein. Examples of chemical groups that can be incorporated into the linker include, but are not limited to, alkyl, alkenyl, alkynyl, amido, amino, ether, thioether, ester, alkylene, heteroalkylene, aryl, or heterocyclyl, each of which can be optionally substituted, as described herein. Examples of linkers include, but are not limited to, unsaturated alkanes, polyethylene glycols (e.g., ethylene or propylene glycol monomeric units, e.g., diethylene glycol, dipropylene glycol, triethylene glycol, tripropylene glycol, tetraethylene glycol, or tetraethylene glycol), and dextran polymers and derivatives thereof. Other examples include, but are not limited to, cleavable moieties within the linker, such as, for example, a disulfide bond (—S—S—) or an azo bond (—N=N—), which can be cleaved using a reducing agent or photolysis. Non-limiting examples of a selectively cleavable bond include an amido bond can be cleaved for example by the use of tris(2-carboxyethyl)phosphine (TCEP), or other reducing agents, and/or photolysis, as well as an ester bond can be cleaved for example by acidic or basic hydrolysis.

Methods of Administration: As used herein, "methods of administration" may include intravenous, intramuscular, intradermal, subcutaneous, or other methods of delivering a composition to a subject. A method of administration may be selected to target delivery (e.g., to specifically deliver) to a specific region or system of a body.

Modified: As used herein "modified" refers to a changed state or structure of a molecule of the disclosure. Molecules can be modified in many ways including chemically, structurally, and functionally. In some embodiments, the mRNA molecules of the present disclosure are modified by the introduction of non-natural nucleosides and/or nucleotides, e.g., as it relates to the natural ribonucleotides A, U, G, and C. Noncanonical nucleotides such as the cap structures are not considered "modified" although they differ from the chemical structure of the A, C, G, U ribonucleotides.

Mucus: As used herein, "mucus" refers to the natural substance that is viscous and comprises mucin glycoproteins.

Nanoparticle Composition: As used herein, a "nanoparticle composition" is a composition comprising one or more lipids. Nanoparticle compositions are typically sized on the order of micrometers or smaller and may include a lipid bilayer. Nanoparticle compositions encompass lipid nanoparticles (LNPs), liposomes (e.g., lipid vesicles), and lipoplexes. For example, a nanoparticle composition may be a liposome having a lipid bilayer with a diameter of 500 nm or less.

Naturally occurring: As used herein, "naturally occurring" means existing in nature without artificial aid.

Non-human vertebrate: As used herein, a "non-human vertebrate" includes all vertebrates except *Homo sapiens*, including wild and domesticated species. Examples of non-human vertebrates include, but are not limited to, mammals, such as alpaca, banteng, bison, camel, cat, cattle, deer, dog, donkey, gayal, goat, guinea pig, horse, llama, mule, pig, rabbit, reindeer, sheep water buffalo, and yak.

Nucleic acid sequence: The terms "nucleic acid sequence," "nucleotide sequence," or "polynucleotide sequence" are used interchangeably and refer to a contiguous nucleic acid sequence. The sequence can be either single stranded or double stranded DNA or RNA, e.g., an mRNA.

The term "nucleic acid," in its broadest sense, includes any compound and/or substance that comprises a polymer of nucleotides. These polymers are often referred to as polynucleotides. Exemplary nucleic acids or polynucleotides of the disclosure include, but are not limited to, ribonucleic acids (RNAs), deoxyribonucleic acids (DNAs), threose nucleic acids (TNAs), glycol nucleic acids (GNAs), peptide nucleic acids (PNAs), locked nucleic acids (LNAs, including LNA having a β-D-ribo configuration, α-LNA having an α-L-ribo configuration (a diastereomer of LNA), 2'-amino-LNA having a 2'-amino functionalization, and 2'-amino-α-LNA having a 2'-amino functionalization), ethylene nucleic acids (ENA), cyclohexenyl nucleic acids (CeNA) or hybrids or combinations thereof.

The phrase "nucleotide sequence encoding" refers to the nucleic acid (e.g., an mRNA or DNA molecule) coding sequence which encodes a polypeptide. The coding sequence can further include initiation and termination signals operably linked to regulatory elements including a promoter and polyadenylation signal capable of directing expression in the cells of an individual or mammal to which the nucleic acid is administered. The coding sequence can further include sequences that encode signal peptides.

Off-target: As used herein, "off target" refers to any unintended effect on any one or more target, gene, or cellular transcript.

Open reading frame: As used herein, "open reading frame" or "ORF" refers to a sequence which does not contain a stop codon in a given reading frame.

Operably linked: As used herein, the phrase "operably linked" refers to a functional connection between two or more molecules, constructs, transcripts, entities, moieties or the like.

Optionally substituted: Herein a phrase of the form "optionally substituted X" (e.g., optionally substituted alkyl) is intended to be equivalent to "X, wherein X is optionally substituted" (e.g., "alkyl, wherein said alkyl is optionally substituted"). It is not intended to mean that the feature "X" (e.g., alkyl) per se is optional.

Part: As used herein, a "part" or "region" of a polynucleotide is defined as any portion of the polynucleotide that is less than the entire length of the polynucleotide.

Patient: As used herein, "patient" refers to a subject who may seek or be in need of treatment, requires treatment, is receiving treatment, will receive treatment, or a subject who is under care by a trained professional for a particular disease or condition.

Pharmaceutically acceptable: The phrase "pharmaceutically acceptable" is employed herein to refer to those compounds, materials, compositions, and/or dosage forms that are, within the scope of sound medical judgment, suitable for use in contact with the tissues of human beings and animals without excessive toxicity, irritation, allergic response, or other problem or complication, commensurate with a reasonable benefit/risk ratio.

Pharmaceutically acceptable excipients: The phrase "pharmaceutically acceptable excipient," as used herein, refers any ingredient other than the compounds described herein (for example, a vehicle capable of suspending or dissolving the active compound) and having the properties of being substantially nontoxic and non-inflammatory in a patient. Excipients can include, for example: antiadherents, antioxidants, binders, coatings, compression aids, disintegrants, dyes (colors), emollients, emulsifiers, fillers (diluents), film formers or coatings, flavors, fragrances, glidants (flow enhancers), lubricants, preservatives, printing inks, sorbents, suspending or dispersing agents, sweeteners, and waters of hydration. Exemplary excipients include, but are not limited to: butylated hydroxytoluene (BHT), calcium carbonate, calcium phosphate (dibasic), calcium stearate, croscarmellose, crosslinked polyvinyl pyrrolidone, citric acid, crospovidone, cysteine, ethylcellulose, gelatin, hydroxypropyl cellulose, hydroxypropyl methylcellulose, lactose, magnesium stearate, maltitol, mannitol, methionine, methylcellulose, methyl paraben, microcrystalline cellulose, polyethylene glycol, polyvinyl pyrrolidone, povidone, pregelatinized starch, propyl paraben, retinyl palmitate, shellac, silicon dioxide, sodium carboxymethyl cellulose, sodium citrate, sodium starch glycolate, sorbitol, starch (corn), stearic acid, sucrose, talc, titanium dioxide, vitamin A, vitamin E, vitamin C, and xylitol.

Pharmaceutically acceptable salts: The present disclosure also includes pharmaceutically acceptable salts of the compounds described herein. As used herein, "pharmaceutically acceptable salts" refers to derivatives of the disclosed compounds wherein the parent compound is modified by converting an existing acid or base moiety to its salt form (e.g., by reacting the free base group with a suitable organic acid). Examples of pharmaceutically acceptable salts include, but are not limited to, mineral or organic acid salts of basic residues such as amines; alkali or organic salts of acidic residues such as carboxylic acids; and the like. Representative acid addition salts include acetate, acetic acid, adipate, alginate, ascorbate, aspartate, benzenesulfonate, benzene sulfonic acid, benzoate, bisulfate, borate, butyrate, camphorate, camphorsulfonate, citrate, cyclopentanepropionate, digluconate, dodecylsulfate, ethanesulfonate, fumarate, glucoheptonate, glycerophosphate, hemisulfate, heptonate, hexanoate, hydrobromide, hydrochloride, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, toluenesulfonate, undecanoate, valerate salts, and the like. Representative alkali or alkaline earth metal salts include sodium, lithium, potassium, calcium, magnesium, and the like, as well as nontoxic ammonium, quaternary ammonium, and amine cations, including, but not limited to ammonium, tetramethylammonium, tetraethylammonium, methylamine, dimethylamine, trimethylamine, triethylamine, ethylamine, and the like. The pharmaceutically acceptable salts of the present disclosure include the conventional non-toxic salts of the parent compound formed, for example, from non-toxic inorganic or organic acids. The pharmaceutically acceptable salts of the present disclosure can be synthesized from the parent compound that contains a basic or acidic moiety by conventional chemical methods. Generally, such salts can be prepared by reacting the free acid or base forms of these compounds with a stoichiometric amount of the appropriate base or acid in water or in an organic solvent, or in a mixture of the two; generally, nonaqueous media like ether, ethyl acetate, ethanol, isopropanol, or acetonitrile are used. Lists of suitable salts are found in *Remington's Pharmaceutical Sciences*, 17$^{th}$ ed., Mack Publishing Company, Easton, Pa., 1985, p. 1418, *Pharmaceutical Salts: Properties, Selection, and Use*, P. H. Stahl and C. G. Wermuth (eds.), Wiley-VCH, 2008, and Berge et al., *Journal of Pharmaceutical Science*, 66, 1-19 (1977), each of which is incorporated herein by reference in its entirety.

Pharmaceutically acceptable solvate: The term "pharmaceutically acceptable solvate," as used herein, means a compound of the disclosure wherein molecules of a suitable solvent are incorporated in the crystal lattice. A suitable solvent is physiologically tolerable at the dosage administered. For example, solvates can be prepared by crystallization, recrystallization, or precipitation from a solution that includes organic solvents, water, or a mixture thereof. Examples of suitable solvents are ethanol, water (for example, mono-, di-, and tri-hydrates), N-methylpyrrolidinone (NMP), dimethyl sulfoxide (DMSO), N,N'-dimethylformamide (DMF), N,N'-dimethylacetamide (DMAC), 1,3-dimethyl-2-imidazolidinone (DMEU), 1,3-dimethyl-3,4,5,6-tetrahydro-2-(1H)-pyrimidinone (DMPU), acetonitrile (ACN), propylene glycol, ethyl acetate, benzyl alcohol, 2-pyrrolidone, benzyl benzoate, and the like. When water is the solvent, the solvate is referred to as a "hydrate."

Pharmacokinetic: As used herein, "pharmacokinetic" refers to any one or more properties of a molecule or compound as it relates to the determination of the fate of substances administered to a living organism. Pharmacokinetics is divided into several areas including the extent and rate of absorption, distribution, metabolism and excretion. This is commonly referred to as ADME where: (A) Absorption is the process of a substance entering the blood circulation; (D) Distribution is the dispersion or dissemination of substances throughout the fluids and tissues of the body; (M) Metabolism (or Biotransformation) is the irreversible transformation of parent compounds into daughter metabolites; and (E) Excretion (or Elimination) refers to the elimination of the substances from the body. In rare cases, some drugs irreversibly accumulate in body tissue.

Physicochemical: As used herein, "physicochemical" means of or relating to a physical and/or chemical property.

Polynucleotide: The term "polynucleotide" as used herein refers to polymers of nucleotides of any length, including ribonucleotides, deoxyribonucleotides, analogs thereof, or mixtures thereof. This term refers to the primary structure of the molecule. Thus, the term includes triple-, double- and single-stranded deoxyribonucleic acid ("DNA"), as well as triple-, double- and single-stranded ribonucleic acid ("RNA"). It also includes modified, for example by alkylation, and/or by capping, and unmodified forms of the polynucleotide. More particularly, the term "polynucleotide" includes polydeoxyribonucleotides (containing 2-deoxy-D-ribose), polyribonucleotides (containing D-ribose), including tRNA, rRNA, hRNA, siRNA and mRNA, whether spliced or unspliced, any other type of polynucleotide which is an N- or C-glycoside of a purine or pyrimidine base, and other polymers containing normucleotidic backbones, for example, polyamide (e.g., peptide nucleic acids "PNAs") and polymorpholino polymers, and other synthetic sequence-specific nucleic acid polymers providing that the polymers contain nucleobases in a configuration which allows for base pairing and base stacking, such as is found in DNA and RNA. In particular aspects, the polynucleotide comprises an mRNA. In other aspect, the mRNA is a synthetic mRNA. In some aspects, the synthetic mRNA comprises at least one unnatural nucleobase. In some aspects, all nucleobases of a certain class have been replaced with unnatural nucleobases (e.g., all uridines in a polynucleotide disclosed herein can be replaced with an unnatural nucleobase, e.g., 5-methoxyuridine). In some aspects, the polynucleotide (e.g., a synthetic RNA or a synthetic DNA) comprises only natural nucleobases, i.e., A (adenosine), G (guanosine), C (cytidine), and T (thymidine) in the case of a synthetic DNA, or A, C, G, and U (uridine) in the case of a synthetic RNA.

The skilled artisan will appreciate that the T bases in the codon maps disclosed herein are present in DNA, whereas the T bases would be replaced by U bases in corresponding RNAs. For example, a codon-nucleotide sequence disclosed herein in DNA form, e.g., a vector or an in-vitro translation (IVT) template, would have its T bases transcribed as U based in its corresponding transcribed mRNA. In this respect, both codon-optimized DNA sequences (comprising T) and their corresponding mRNA sequences (comprising U) are considered codon-optimized nucleotide sequence of the present disclosure. A skilled artisan would also understand that equivalent codon-maps can be generated by replaced one or more bases with non-natural bases. Thus, e.g., a TTC codon (DNA map) would correspond to a UUC codon (RNA map), which in turn would correspond to a ΨΨC codon (RNA map in which U has been replaced with pseudouridine).

Standard A-T and G-C base pairs form under conditions which allow the formation of hydrogen bonds between the N3-H and C4-oxy of thymidine and the N1 and C6-NH2, respectively, of adenosine and between the C2-oxy, N3 and C4-NH2, of cytidine and the C2-NH2, N'—H and C6-oxy, respectively, of guanosine. Thus, for example, guanosine (2-amino-6-oxy-9-β-D-ribofuranosyl-purine) can be modified to form isoguanosine (2-oxy-6-amino-9-β-D-ribofuranosyl-purine). Such modification results in a nucleoside base which will no longer effectively form a standard base pair with cytosine. However, modification of cytosine (1-β-D-ribofuranosyl-2-oxy-4-amino-pyrimidine) to form isocytosine (1-β-D-ribofuranosyl-2-amino-4-oxy-pyrimidine-) results in a modified nucleotide which will not effectively base pair with guanosine but will form a base pair with isoguanosine (U.S. Pat. No. 5,681,702 to Collins et al.). Isocytosine is available from Sigma Chemical Co. (St. Louis, Mo.); isocytidine can be prepared by the method described by Switzer et al. (1993) Biochemistry 32:10489-10496 and references cited therein; 2'-deoxy-5-methyl-isocytidine can be prepared by the method of Tor et al., 1993, J. Am. Chem. Soc. 115:4461-4467 and references cited therein; and isoguanine nucleotides can be prepared using the method described by Switzer et al., 1993, supra, and Mantsch et al., 1993, Biochem. 14:5593-5601, or by the method described in U.S. Pat. No. 5,780,610 to Collins et al. Other nonnatural base pairs can be synthesized by the method described in Piccirilli et al., 1990, Nature 343:33-37, for the synthesis of 2,6-diaminopyrimidine and its complement (1-methylpyrazolo-[4,3]pyrimidine-5,7-(4H,6H)-dione. Other such modified nucleotide units which form unique base pairs are known, such as those described in Leach et al. (1992) J. Am. Chem. Soc. 114:3675-3683 and Switzer et al., supra.

Polypeptide: The terms "polypeptide," "peptide," and "protein" are used interchangeably herein to refer to polymers of amino acids of any length. The polymer can comprise modified amino acids. The terms also encompass an amino acid polymer that has been modified naturally or by intervention; for example, disulfide bond formation, glycosylation, lipidation, acetylation, phosphorylation, or any other manipulation or modification, such as conjugation with a labeling component. Also included within the definition are, for example, polypeptides containing one or more analogs of an amino acid (including, for example, unnatural amino acids such as homocysteine, ornithine, p-acetylphenylalanine, D-amino acids, and creatine), as well as other modifications known in the art.

The term, as used herein, refers to proteins, polypeptides, and peptides of any size, structure, or function. Polypeptides include encoded polynucleotide products, naturally occurring polypeptides, synthetic polypeptides, homologs, orthologs, paralogs, fragments and other equivalents, variants, and analogs of the foregoing. A polypeptide can be a monomer or can be a multi-molecular complex such as a dimer, trimer or tetramer. They can also comprise single chain or multichain polypeptides. Most commonly disulfide linkages are found in multichain polypeptides. The term polypeptide can also apply to amino acid polymers in which one or more amino acid residues are an artificial chemical analogue of a corresponding naturally occurring amino acid. In some embodiments, a "peptide" can be less than or equal to 50 amino acids long, e.g., about 5, 10, 15, 20, 25, 30, 35, 40, 45, or 50 amino acids long.

Polypeptide variant: As used herein, the term "polypeptide variant" refers to molecules that differ in their amino acid sequence from a native or reference sequence. The amino acid sequence variants can possess substitutions, deletions, and/or insertions at certain positions within the amino acid sequence, as compared to a native or reference sequence. Ordinarily, variants will possess at least about 50% identity, at least about 60% identity, at least about 70% identity, at least about 80% identity, at least about 90% identity, at least about 95% identity, at least about 99% identity to a native or reference sequence. In some embodiments, they will be at least about 80%, or at least about 90% identical to a native or reference sequence.

Polypeptide per unit drug (PUD): As used herein, a PUD or product per unit drug, is defined as a subdivided portion of total daily dose, usually 1 mg, pg, kg, etc., of a product (such as a polypeptide) as measured in body fluid or tissue, usually defined in concentration such as pmol/mL, mmol/mL, etc. divided by the measure in the body fluid.

Preventing: As used herein, the term "preventing" refers to partially or completely delaying onset of an infection, disease, disorder and/or condition; partially or completely delaying onset of one or more symptoms, features, or clinical manifestations of a particular infection, disease, disorder, and/or condition; partially or completely delaying onset of one or more symptoms, features, or manifestations of a particular infection, disease, disorder, and/or condition; partially or completely delaying progression from an infection, a particular disease, disorder and/or condition; and/or decreasing the risk of developing pathology associated with the infection, the disease, disorder, and/or condition.

Proliferate: As used herein, the term "proliferate" means to grow, expand or increase or cause to grow, expand or increase rapidly. "Proliferative" means having the ability to proliferate. "Anti-proliferative" means having properties counter to or inapposite to proliferative properties.

Prophylactic: As used herein, "prophylactic" refers to a therapeutic or course of action used to prevent the spread of disease.

Prophylaxis: As used herein, a "prophylaxis" refers to a measure taken to maintain health and prevent the spread of disease. An "immune prophylaxis" refers to a measure to produce active or passive immunity to prevent the spread of disease.

Protein cleavage site: As used herein, "protein cleavage site" refers to a site where controlled cleavage of the amino acid chain can be accomplished by chemical, enzymatic or photochemical means.

Protein cleavage signal: As used herein "protein cleavage signal" refers to at least one amino acid that flags or marks a polypeptide for cleavage.

Protein of interest: As used herein, the terms "proteins of interest" or "desired proteins" include those provided herein and fragments, mutants, variants, and alterations thereof.

Proximal: As used herein, the term "proximal" means situated nearer to the center or to a point or region of interest.

Pseudouridine: As used herein, pseudouridine ($\psi$) refers to the C-glycoside isomer of the nucleoside uridine. A "pseudouridine analog" is any modification, variant, isoform or derivative of pseudouridine. For example, pseudouridine analogs include but are not limited to 1-carboxymethyl-pseudouridine, 1-propynyl-pseudouridine, 1-taurinomethyl-pseudouridine, 1-taurinomethyl-4-thio-pseudouridine, 1-methylpseudouridine ($m^1\psi$), 1-methyl-4-thio-pseudouridine ($m^1s^4\psi$), 4-thio-1-methyl-pseudouridine, 3-methyl-pseudouridine ($m^3\psi$), 2-thio-1-methyl-pseudouridine, 1-methyl-1-deaza-pseudouridine, 2-thio-1-methyl-1-deaza-pseudouridine, dihydropseudouridine, 2-thio-dihydropseudouridine, 2-methoxyuridine, 2-methoxy-4-thio-uridine, 4-methoxy-pseudouridine, 4-methoxy-2-thio-pseudouridine, N1-methyl-pseudouridine, 1-methyl-3-(3-amino-3-carboxypropyl)pseudouridine ($acp^3\psi$), and 2'-O-methyl-pseudouridine ($\psi m$).

Purified: As used herein, "purify," "purified," "purification" means to make substantially pure or clear from unwanted components, material defilement, admixture or imperfection.

Reference Nucleic Acid Sequence: The term "reference nucleic acid sequence" or "reference nucleic acid" or "reference nucleotide sequence" or "reference sequence" refers to a starting nucleic acid sequence (e.g., a RNA, e.g., an mRNA sequence) that can be sequence optimized. In some embodiments, the reference nucleic acid sequence is a wild type nucleic acid sequence, a fragment or a variant thereof. In some embodiments, the reference nucleic acid sequence is a previously sequence optimized nucleic acid sequence.

Salts: In some aspects, the pharmaceutical composition for intratumoral delivery disclosed herein and comprises salts of some of their lipid constituents. The term "salt" includes any anionic and cationic complex. Non-limiting examples of anions include inorganic and organic anions, e.g., fluoride, chloride, bromide, iodide, oxalate (e.g., hemioxalate), phosphate, phosphonate, hydrogen phosphate, dihydrogen phosphate, oxide, carbonate, bicarbonate, nitrate, nitrite, nitride, bisulfite, sulfide, sulfite, bisulfate, sulfate, thiosulfate, hydrogen sulfate, borate, formate, acetate, benzoate, citrate, tartrate, lactate, acrylate, polyacrylate, fumarate, maleate, itaconate, glycolate, gluconate, malate, mandelate, tiglate, ascorbate, salicylate, polymethacrylate, perchlorate, chlorate, chlorite, hypochlorite, bromate, hypobromite, iodate, an alkylsulfonate, an arylsulfonate, arsenate, arsenite, chromate, dichromate, cyanide, cyanate, thiocyanate, hydroxide, peroxide, permanganate, and mixtures thereof.

Sample: As used herein, the term "sample" or "biological sample" refers to a subset of its tissues, cells or component parts (e.g., body fluids, including but not limited to blood, mucus, lymphatic fluid, synovial fluid, cerebrospinal fluid, saliva, amniotic fluid, amniotic cord blood, urine, vaginal fluid and semen). A sample further can include a homogenate, lysate or extract prepared from a whole organism or a subset of its tissues, cells or component parts, or a fraction or portion thereof, including but not limited to, for example, plasma, serum, spinal fluid, lymph fluid, the external sections of the skin, respiratory, intestinal, and genitourinary tracts, tears, saliva, milk, blood cells, tumors, organs. A sample further refers to a medium, such as a nutrient broth or gel, which may contain cellular components, such as proteins or nucleic acid molecule.

Signal Sequence: As used herein, the phrases "signal sequence," "signal peptide," and "transit peptide" are used interchangeably and refer to a sequence that can direct the transport or localization of a protein to a certain organelle, cell compartment, or extracellular export. The term encompasses both the signal sequence polypeptide and the nucleic acid sequence encoding the signal sequence. Thus, references to a signal sequence in the context of a nucleic acid refer in fact to the nucleic acid sequence encoding the signal sequence polypeptide.

Signal transduction pathway: A "signal transduction pathway" refers to the biochemical relationship between a variety of signal transduction molecules that play a role in the transmission of a signal from one portion of a cell to another portion of a cell. As used herein, the phrase "cell surface receptor" includes, for example, molecules and complexes of molecules capable of receiving a signal and the transmission of such a signal across the plasma membrane of a cell.

Similarity: As used herein, the term "similarity" refers to the overall relatedness between polymeric molecules, e.g. between polynucleotide molecules (e.g. DNA molecules and/or RNA molecules) and/or between polypeptide molecules. Calculation of percent similarity of polymeric molecules to one another can be performed in the same manner as a calculation of percent identity, except that calculation of percent similarity takes into account conservative substitutions as is understood in the art.

Single unit dose: As used herein, a "single unit dose" is a dose of any therapeutic administered in one dose/at one time/single route/single point of contact, i.e., single administration event.

Split dose: As used herein, a "split dose" is the division of single unit dose or total daily dose into two or more doses.

Specific delivery: As used herein, the term "specific delivery," "specifically deliver," or "specifically delivering" means delivery of more (e.g., at least 1.5 fold more, at least 2-fold more, at least 3-fold more, at least 4-fold more, at least 5-fold more, at least 6-fold more, at least 7-fold more, at least 8-fold more, at least 9-fold more, at least 10-fold more) of a polynucleotide by a nanoparticle to a target tissue of interest (e.g., mammalian liver) compared to an off-target tissue (e.g., mammalian spleen). The level of delivery of a nanoparticle to a particular tissue may be measured by comparing the amount of protein produced in a tissue to the weight of said tissue, comparing the amount of polynucleotide in a tissue to the weight of said tissue, comparing the amount of protein produced in a tissue to the amount of total protein in said tissue, or comparing the amount of polynucleotide in a tissue to the amount of total polynucleotide in said tissue. For example, for renovascular targeting, a polynucleotide is specifically provided to a mammalian kidney as compared to the liver and spleen if 1.5, 2-fold, 3-fold, 5-fold, 10-fold, 15 fold, or 20 fold more polynucleotide per 1 g of tissue is delivered to a kidney compared to that delivered to the liver or spleen following systemic administration of the polynucleotide. It will be understood that the ability of a nanoparticle to specifically deliver to a target tissue need not be determined in a subject being treated, it may be determined in a surrogate such as an animal model (e.g., a rat model).

Stable: As used herein "stable" refers to a compound that is sufficiently robust to survive isolation to a useful degree of purity from a reaction mixture, and in some cases capable of formulation into an efficacious therapeutic agent.

Stabilized: As used herein, the term "stabilize," "stabilized," "stabilized region" means to make or become stable.

Stereoisomer: As used herein, the term "stereoisomer" refers to all possible different isomeric as well as conformational forms that a compound may possess (e.g., a compound of any formula described herein), in particular all possible stereochemically and conformationally isomeric forms, all diastereomers, enantiomers and/or conformers of the basic molecular structure. Some compounds of the present disclosure may exist in different tautomeric forms, all of the latter being included within the scope of the present disclosure.

Subject: By "subject" or "individual" or "animal" or "patient" or "mammal," is meant any subject, particularly a mammalian subject, for whom diagnosis, prognosis, or therapy is desired. Mammalian subjects include, but are not limited to, humans, domestic animals, farm animals, zoo animals, sport animals, pet animals such as dogs, cats, guinea pigs, rabbits, rats, mice, horses, cattle, cows; primates such as apes, monkeys, orangutans, and chimpanzees; canids such as dogs and wolves; felids such as cats, lions, and tigers; equids such as horses, donkeys, and zebras; bears, food animals such as cows, pigs, and sheep; ungulates such as deer and giraffes; rodents such as mice, rats, hamsters and guinea pigs; and so on. In certain embodiments, the mammal is a human subject. In other embodiments, a subject is a human patient. In a particular embodiment, a subject is a human patient in need of treatment.

Substantially: As used herein, the term "substantially" refers to the qualitative condition of exhibiting total or near-total extent or degree of a characteristic or property of interest. One of ordinary skill in the biological arts will understand that biological and chemical characteristics rarely, if ever, go to completion and/or proceed to completeness or achieve or avoid an absolute result. The term "substantially" is therefore used herein to capture the potential lack of completeness inherent in many biological and chemical characteristics.

Substantially equal: As used herein as it relates to time differences between doses, the term means plus/minus 2%.

Substantially simultaneous: As used herein and as it relates to plurality of doses, the term means within 2 seconds.

Suffering from: An individual who is "suffering from" a disease, disorder, and/or condition has been diagnosed with or displays one or more symptoms of the disease, disorder, and/or condition.

Susceptible to: An individual who is "susceptible to" a disease, disorder, and/or condition has not been diagnosed with and/or may not exhibit symptoms of the disease, disorder, and/or condition but harbors a propensity to develop a disease or its symptoms. In some embodiments, an individual who is susceptible to a disease, disorder, and/or condition (for example, cancer) can be characterized by one or more of the following: (1) a genetic mutation associated with development of the disease, disorder, and/or condition; (2) a genetic polymorphism associated with development of the disease, disorder, and/or condition; (3) increased and/or decreased expression and/or activity of a protein and/or nucleic acid associated with the disease, disorder, and/or condition; (4) habits and/or lifestyles associated with development of the disease, disorder, and/or condition; (5) a family history of the disease, disorder, and/or condition; and (6) exposure to and/or infection with a microbe associated with development of the disease, disorder, and/or condition.

In some embodiments, an individual who is susceptible to a disease, disorder, and/or condition will develop the disease, disorder, and/or condition. In some embodiments, an individual who is susceptible to a disease, disorder, and/or condition will not develop the disease, disorder, and/or condition.

Sustained release: As used herein, the term "sustained release" refers to a pharmaceutical composition or compound release profile that conforms to a release rate over a specific period of time.

Synthetic: The term "synthetic" means produced, prepared, and/or manufactured by the hand of man. Synthesis of polynucleotides or other molecules of the present disclosure can be chemical or enzymatic.

Targeted Cells: As used herein, "targeted cells" refers to any one or more cells of interest. The cells can be found in vitro, in vivo, in situ or in the tissue or organ of an organism. The organism can be an animal, for example a mammal, a human, a subject or a patient.

Target tissue: As used herein "target tissue" refers to any one or more tissue types of interest in which the delivery of a polynucleotide would result in a desired biological and/or pharmacological effect. Examples of target tissues of interest include specific tissues, organs, and systems or groups thereof. In particular applications, a target tissue may be a kidney, a lung, a spleen, vascular endothelium in vessels (e.g., intra-coronary or intra-femoral), or tumor tissue (e.g., via intratumoral injection). An "off-target tissue" refers to any one or more tissue types in which the expression of the encoded protein does not result in a desired biological and/or pharmacological effect. In particular applications, off-target tissues may include the liver and the spleen.

The presence of a therapeutic agent in an off-target issue can be the result of: (i) leakage of a polynucleotide from the administration site to peripheral tissue or distant off-target tissue (e.g., liver) via diffusion or through the bloodstream (e.g., a polynucleotide intended to express a polypeptide in a certain tissue would reach the liver and the polypeptide would be expressed in the liver); or (ii) leakage of an polypeptide after administration of a polynucleotide encoding such polypeptide to peripheral tissue or distant off-target tissue (e.g., liver) via diffusion or through the bloodstream (e.g., a polynucleotide would expressed a polypeptide in the target tissue, and the polypeptide would diffuse to peripheral tissue).

Targeting sequence: As used herein, the phrase "targeting sequence" refers to a sequence that can direct the transport or localization of a protein or polypeptide.

Terminus: As used herein the terms "termini" or "terminus," when referring to polypeptides, refers to an extremity of a peptide or polypeptide. Such extremity is not limited only to the first or final site of the peptide or polypeptide but can include additional amino acids in the terminal regions. The polypeptide based molecules of the disclosure can be characterized as having both an N-terminus (terminated by an amino acid with a free amino group ($NH_2$)) and a C-terminus (terminated by an amino acid with a free carboxyl group (COOH)). Proteins of the disclosure are in some cases made up of multiple polypeptide chains brought together by disulfide bonds or by non-covalent forces (multimers, oligomers). These sorts of proteins will have multiple N- and C-termini. Alternatively, the termini of the polypeptides can be modified such that they begin or end, as the case can be, with a non-polypeptide based moiety such as an organic conjugate.

Therapeutic Agent: The term "therapeutic agent" refers to an agent that, when administered to a subject, has a therapeutic, diagnostic, and/or prophylactic effect and/or elicits a desired biological and/or pharmacological effect. For example, in some embodiments, an mRNA encoding a tethered IL-12 polypeptide as disclosed herein can be a therapeutic agent.

Therapeutically effective amount: As used herein, the term "therapeutically effective amount" means an amount of an agent to be delivered (e.g., nucleic acid, drug, therapeutic agent, diagnostic agent, prophylactic agent, etc.) that is sufficient, when administered to a subject suffering from or susceptible to an infection, disease, disorder, and/or condition, to treat, improve symptoms of, diagnose, prevent, and/or delay the onset of the infection, disease, disorder, and/or condition.

Therapeutically effective outcome: As used herein, the term "therapeutically effective outcome" means an outcome that is sufficient in a subject suffering from or susceptible to an infection, disease, disorder, and/or condition, to treat, improve symptoms of, diagnose, prevent, and/or delay the onset of the infection, disease, disorder, and/or condition.

Total daily dose: As used herein, a "total daily dose" is an amount given or prescribed in 24 hour period. The total daily dose can be administered as a single unit dose or a split dose.

Transmembrane domain: As used herein, the terms "transmembrane domain", "TM" and "TMD" refer to the region of a polypeptide which crosses the plasma membrane of a cell.

Transcription factor: As used herein, the term "transcription factor" refers to a DNA-binding protein that regulates transcription of DNA into RNA, for example, by activation or repression of transcription. Some transcription factors effect regulation of transcription alone, while others act in concert with other proteins. Some transcription factor can both activate and repress transcription under certain conditions. In general, transcription factors bind a specific target sequence or sequences highly similar to a specific consensus sequence in a regulatory region of a target gene. Transcription factors may regulate transcription of a target gene alone or in a complex with other molecules.

Transcription: As used herein, the term "transcription" refers to methods to introduce exogenous nucleic acids into a cell. Methods of transfection include, but are not limited to, chemical methods, physical treatments and cationic lipids or mixtures.

Transcription start site: As used herein, the term "transcription start site" refers to a specific nucleotide in the sense strand of a DNA molecule where transcription by an RNA polymerase initiates and that corresponds to the first nucleotide in the transcript. The transcription start site is typically located downstream of a promoter, which is a region of DNA that initiations transcription. For example, the T7 RNA polymerase initiates transcription at the underlined G in the promoter sequence 5' TAATACGACTCACTATA<u>G</u> 3'. The polymerase then transcribes using the opposite DNA strand as a template. In some embodiments, the transcription start site for a T7 RNA polymerase is referred to as a "T7 start site". The first base in the transcript will be a G. The DNA contacts made by T7 RNA polymerase have been mapped during binding and during the subsequent initiation of transcription. The RNA polymerase alone protects 19 bases in a region from −21 to −3. Synthesis of the trinucleotide r(GGG) expands the length of the sequence protected by the RNA polymerase and stabilizes the complex. The formation of a hexanucleotide mRNA, r(GGGAGA) further extends the protected region, stabilizes the complex, and results in increased transcriptional efficiency (Ikeda and Richardson (1986) Proc Natl Acad Sci 83:3614-3618). The sequence GGGAGA is referred to as a "T7 leader sequence". Accordingly, in some embodiments, the mRNAs provided by the disclosure comprise a 5' UTR comprising a T7 leader sequence at the 5' end of the 5' UTR. In some embodiments, the mRNA of the disclosure comprises a 5' UTR comprising a T7 leader sequence comprising the sequence GGGAGA at the 5' end of the 5' UTR. In some embodiments, the mRNA of the disclosure comprises a 5' UTR comprising a T7 leader sequence comprising the sequence GGGAAA at the 5' end of the 5' UTR. In some embodiments, the mRNA comprises a 5' UTR which does not comprise a T7 leader sequence.

Transfection: As used herein, "transfection" refers to the introduction of a polynucleotide into a cell wherein a polypeptide encoded by the polynucleotide is expressed (e.g., mRNA) or the polypeptide modulates a cellular function (e.g., siRNA, miRNA). As used herein, "expression" of a nucleic acid sequence refers to translation of a polynucleotide (e.g., an mRNA) into a polypeptide or protein and/or post-translational modification of a polypeptide or protein.

Treating, treatment, therapy: As used herein, the term "treating" or "treatment" or "therapy" refers to partially or completely alleviating, ameliorating, improving, relieving, delaying onset of, inhibiting progression of, reducing severity of, and/or reducing incidence of one or more symptoms or features of a disease, e.g., acute intermittent porphyria. For example, "treating" acute intermittent porphyria can refer to diminishing symptoms associate with the disease, prolong the lifespan (increase the survival rate) of patients, reducing the severity of the disease, preventing or delaying the onset of the disease, etc. Treatment can be administered to a subject who does not exhibit signs of a disease, disorder, and/or condition and/or to a subject who exhibits only early signs of a disease, disorder, and/or condition for the purpose of decreasing the risk of developing pathology associated with the disease, disorder, and/or condition.

Type I integral membrane protein: As used herein, the term "type I integral membrane protein" refers to an integral membrane protein (i.e., proteins having at least one transmembrane domain that crosses the lipid bilayer) with its amino-terminus in the extracellular space and comprising one alpha-helical transmembrane domain.

Unmodified: As used herein, "unmodified" refers to any substance, compound or molecule prior to being changed in some way. Unmodified can, but does not always, refer to the wild type or native form of a biomolecule. Molecules can undergo a series of modifications whereby each modified molecule can serve as the "unmodified" starting molecule for a subsequent modification.

Uracil: Uracil is one of the four nucleobases in the nucleic acid of RNA, and it is represented by the letter U. Uracil can be attached to a ribose ring, or more specifically, a ribofuranose via a β-$N_1$-glycosidic bond to yield the nucleoside uridine. The nucleoside uridine is also commonly abbreviated according to the one letter code of its nucleobase, i.e., U. Thus, in the context of the present disclosure, when a monomer in a polynucleotide sequence is U, such U is designated interchangeably as a "uracil" or a "uridine."

Uridine Content: The terms "uridine content" or "uracil content" are interchangeable and refer to the amount of uracil or uridine present in a certain nucleic acid sequence. Uridine content or uracil content can be expressed as an absolute value (total number of uridine or uracil in the sequence) or relative (uridine or uracil percentage respect to the total number of nucleobases in the nucleic acid sequence).

Uridine-Modified Sequence: The terms "uridine-modified sequence" refers to a sequence optimized nucleic acid (e.g., a synthetic mRNA sequence) with a different overall or local uridine content (higher or lower uridine content) or with different uridine patterns (e.g., gradient distribution or clustering) with respect to the uridine content and/or uridine patterns of a candidate nucleic acid sequence. In the content of the present disclosure, the terms "uridine-modified sequence" and "uracil-modified sequence" are considered equivalent and interchangeable.

A "high uridine codon" is defined as a codon comprising two or three uridines, a "low uridine codon" is defined as a codon comprising one uridine, and a "no uridine codon" is a codon without any uridines. In some embodiments, a uridine-modified sequence comprises substitutions of high uridine codons with low uridine codons, substitutions of high uridine codons with no uridine codons, substitutions of low uridine codons with high uridine codons, substitutions of low uridine codons with no uridine codons, substitution of no uridine codons with low uridine codons, substitutions of no uridine codons with high uridine codons, and combinations thereof. In some embodiments, a high uridine codon can be replaced with another high uridine codon. In some embodiments, a low uridine codon can be replaced with another low uridine codon. In some embodiments, a no uridine codon can be replaced with another no uridine codon. A uridine-modified sequence can be uridine enriched or uridine rarefied.

Uridine Enriched: As used herein, the terms "uridine enriched" and grammatical variants refer to the increase in uridine content (expressed in absolute value or as a percentage value) in a sequence optimized nucleic acid (e.g., a synthetic mRNA sequence) with respect to the uridine content of the corresponding candidate nucleic acid sequence. Uridine enrichment can be implemented by substituting codons in the candidate nucleic acid sequence with synonymous codons containing less uridine nucleobases. Uridine enrichment can be global (i.e., relative to the entire length of a candidate nucleic acid sequence) or local (i.e., relative to a subsequence or region of a candidate nucleic acid sequence).

Uridine Rarefied: As used herein, the terms "uridine rarefied" and grammatical variants refer to a decrease in uridine content (expressed in absolute value or as a percentage value) in a sequence optimized nucleic acid (e.g., a synthetic mRNA sequence) with respect to the uridine content of the corresponding candidate nucleic acid sequence. Uridine rarefication can be implemented by substituting codons in the candidate nucleic acid sequence with synonymous codons containing less uridine nucleobases. Uridine rarefication can be global (i.e., relative to the entire length of a candidate nucleic acid sequence) or local (i.e., relative to a subsequence or region of a candidate nucleic acid sequence).

Variant: The term variant as used in present disclosure refers to both natural variants (e.g., polymorphisms, isoforms, etc) and artificial variants in which at least one amino acid residue in a native or starting sequence (e.g., a wild type sequence) has been removed and a different amino acid inserted in its place at the same position. These variants can be described as "substitutional variants." The substitutions can be single, where only one amino acid in the molecule has been substituted, or they can be multiple, where two or more amino acids have been substituted in the same molecule. If amino acids are inserted or deleted, the resulting variant would be an "insertional variant" or a "deletional variant" respectively.

31. Other Embodiments

E1. A polynucleotide comprising an open reading frame (ORF) comprising: (a) a first nucleic acid sequence encoding an Interleukin-12 p40 subunit (IL-12B), (b) a second nucleic acid sequence encoding an Interleukin-12 p35 subunit (IL-12A), and (c) a nucleic acid sequence encoding a transmembrane domain,
wherein the first nucleic acid sequence and the second nucleic acid sequence are linked by a nucleic acid sequence encoding a linker ("subunit linker"), and
wherein the nucleic acid sequence encoding the transmembrane domain is linked to the first or second nucleic acid sequence by a nucleic acid sequence encoding a linker ("transmembrane domain linker").

E2. The polynucleotide of embodiment 1, wherein the first nucleic acid sequence is located at the 5' end of the subunit linker.

E3. The polynucleotide of embodiment 2, wherein the nucleic acid sequence encoding the transmembrane domain is located at the 3' end of the transmembrane domain linker.

E4. The polynucleotide of any one of embodiments 1 to 3, wherein the polynucleotide further comprises a nucleic acid sequence encoding a signal peptide.

E5. The polynucleotide of embodiment 4, wherein the nucleic acid sequence encoding the signal peptide is located at the 5' end of the first nucleic acid sequence.

E6. The polynucleotide of any one of embodiments 1 to 5, wherein the IL12B has an amino acid sequence at least about 80%, at least about 90%, at least about 95%, at least 96%, at least 97%, at least 98%, at least 99%, or 100% identical to amino acids 23 to 328 of SEQ ID NO: 48, and wherein the amino acid sequence has IL12B activity.

E7. The polynucleotide of any one of embodiments 1 to 6, wherein the IL12A has an amino acid sequence at least about 80%, at least about 90%, at least about 95%, at least 96%, at least 97%, at least 98%, at least 99%, or 100% identical to amino acids 336 to 532 of SEQ ID NO: 48, and wherein the amino acid sequence has IL12A activity.

E8. The polynucleotide of any one of embodiments 4 to 7, wherein the signal peptide comprises a sequence at least about 80%, at least about 90%, at least about 95%, at least 96%, at least 97%, at least 98%, at least 99%, or 100% identical to amino acids 1 to 22 of SEQ ID NO: 48.

E9. The polynucleotide of any one of embodiments 1 to 8, wherein the subunit linker is a Gly/Ser linker.

E10. The polynucleotide of any one of embodiments 1 to 9, wherein the transmembrane domain linker is a Gly/Ser linker.

E11. The polynucleotide of embodiment 9 or embodiment 10, wherein the Gly/Ser linker comprises $(G_nS)_m$, wherein n is 1, 2 3, 4, 5, 6, 7, 8, 9, 10, 15, or 20 and m is 1, 2, 3, 4, 5, 6, 7, 8, 9, 10, 15, or 20.

E12. The polynucleotide of any one of embodiments 1-11, wherein the transmembrane domain is a type I transmembrane domain.

E13. The polynucleotide of any one of embodiments 1-12, wherein the transmembrane domain is a Cluster of Differentiation 8 (CD8) transmembrane domain or a Platelet-Derived Growth Factor Receptor (PDGF-R) transmembrane domain.

E14. The polynucleotide of any one of embodiments 1 to 13, wherein the polynucleotide is DNA.

E15. The polynucleotide of any one of embodiments 1 to 13, wherein the polynucleotide is RNA.

E16. The polynucleotide of embodiment 15, wherein the polynucleotide is mRNA.

E17. The polynucleotide of any one of embodiments 1 to 16, wherein the polynucleotide comprises at least one chemically modified nucleobase.

E18. The polynucleotide of embodiment 17, wherein the at least one chemically modified nucleobase is selected from the group consisting of pseudouracil (ψ), N1-methylpseudouracil (m1ψ), 2-thiouracil (s2U), 4'-thiouracil, 5-methylcytosine, 2-thio-1-methyl-1-deaza-pseudouracil, 2-thio-1-methyl-pseudouracil, 2-thio-5-aza-uracil, 2-thio-dihydropseudouracil, 2-thio-dihydrouracil, 2-thio-pseudouracil, 4-methoxy-2-thio-pseudouracil, 4-methoxy-pseudouracil, 4-thio-1-methyl-pseudouracil, 4-thio-pseudouracil, 5-aza-uracil, dihydropseudouracil, 5-methyluracil, 5-methoxyuracil, 2'-O-methyl uracil, 1-methyl-pseudouracil (m1ψ), 5-methoxy-uracil (mo5U), 5-methyl-cytosine (m5C), α-thio-guanine, α-thio-adenine, 5-cyano uracil, 4'-thio uracil, 7-deaza-adenine, 1-methyl-adenine (m1A), 2-methyl-adenine (m2A), N6-methyl-adenine (m6A), and 2,6-Diaminopurine, (I), 1-methyl-inosine (m1I), wyosine (imG), methylwyosine (mimG), 7-deaza-guanine, 7-cyano-7-deaza-guanine (preQ0), 7-aminomethyl-7-deaza-guanine (preQ1), 7-methyl-guanine (m7G), 1-methyl-guanine (m1G), 8-oxo-guanine, 7-methyl-8-oxo-guanine, and two or more combinations thereof.

E19. The polynucleotide of embodiment 17 or 18, wherein the nucleobases in the polynucleotide are chemically modified by at least about 10%, at least about 20%, at least about 30%, at least about 40%, at least about 50%, at least about 60%, at least about 70%, at least about 80%, at least about 90%, at least 95%, at least 99%, or 100%.

E20. The polynucleotide of any one of embodiments 17 to 19, wherein the chemically modified nucleobases are selected from the group consisting of uracil, adenine, cytosine, guanine, and any combination thereof.

E21. The polynucleotide of any one of embodiments 17 to 20, wherein the uracils, adenines, cytosines or guanines are chemically modified by at least about 10%, at least about 20%, at least about 30%, at least about 40%, at least about 50%, at least about 60%, at least about 70%, at least about 80%, at least about 90%, at least 95%, at least 99%, or 100%.

E22. The polynucleotide of any one of embodiments 1 to 21, wherein the polynucleotide further comprises a nucleic acid sequence comprising a miRNA binding site.

E23. The polynucleotide of embodiment 22, wherein the miRNA binding site binds to miR-122.

E24. The polynucleotide of embodiment 22 or 23, wherein the miRNA binding site binds to miR-122-3p or miR-122-5p.

E25. The polynucleotide of any one of embodiments 1 to 24, wherein the polynucleotide further comprises a 5' UTR.

E26. The polynucleotide of embodiment 25, wherein the 5' UTR comprises a nucleic acid sequence at least 90%, 95%, 96%, 97%, 98%, 99%, or 100% identical to any one of sequences disclosed herein.

E27. The polynucleotide of any one of embodiments 1 to 26, which further comprises a 3' UTR.

E28. The polynucleotide of embodiment 27, wherein the 3' UTR comprises a nucleic acid sequence at least about 90%, at least about 95%, at least 96%, at least 97%, at least 98%, at least 99%, or 100% identical to any one of sequences disclosed herein.

E29. The polynucleotide of embodiment 27 or 28 wherein the miRNA binding site is located within the 3' UTR.

E30. The polynucleotide of any one of embodiments 25 to 29, wherein the 5' UTR comprises a 5' terminal cap.

E31. The polynucleotide of embodiment 30, wherein the 5' terminal cap is a Cap0, Cap1, ARCA, inosine, N1-methyl-guanosine, 2'fluoro-guanosine, 7-deaza-guanosine, 8-oxo-guanosine, 2-amino-guanosine, LNA-guanosine, 2-azidoguanosine, Cap2, Cap4, 5' methylG cap, or an analog thereof.

E32. The polynucleotide of any one of embodiments 1 to 31, wherein the polynucleotide further comprises a poly-A region.

E33. The polynucleotide of embodiment 32, wherein the poly-A region is at least about 10, at least about 20, at least about 30, at least about 40, at least about 50, at least about 60, at least about 70, at least about 80, or at least about 90 nucleotides in length.

E34. The polynucleotide of embodiment 32, wherein the poly-A region has about 10 to about 200 nucleotides in length, about 20 to about 180 nucleotides in length, about 30 to about 160 nucleotides in length, about 40 to about 140 nucleotides in length, about 50 to about 120 nucleotides in length, about 60 to about 100 nucleotides in length, or about 80 to about 90 nucleotides in length.

E35. The polynucleotide of any one of embodiments 1 to 34, wherein the polynucleotide has been transcribed in vitro (IVT).

E36. The polynucleotide of any one of embodiments 1 to 34, wherein the polynucleotide is chimeric.

E37. The polynucleotide of any one of embodiments 1 to 34, wherein the polynucleotide is circular.

E38. The polynucleotide of any one of embodiments 1 to 37, wherein the ORF further comprises one or more nucleic acid sequences encoding one or more heterologous polypeptides fused to the nucleic acid sequence encoding the IL12B, the IL12A, or both.

E39. The polynucleotide of embodiment 38, wherein the one or more heterologous polypeptides increase a pharmacokinetic property of the IL12A, the IL12B, or both.

E40. The polynucleotide of any one of embodiments 1 to 39, which is single stranded.

E41. The polynucleotide of any one of embodiments 1 to 39, which is double stranded.

E42. The polynucleotide of any one of embodiments 1 to 41, wherein the IL12B is a variant, derivative, or a mutant having an IL12B activity.

E43. The polynucleotide of any one of embodiments 1 to 41, wherein the IL12A is a variant, derivative, or a mutant having an IL12A activity.

E44. A vector comprising the polynucleotide of any one of embodiments 1 to 43.

E45. A composition comprising (i) the polynucleotide of any one of embodiments 1 to 44 or the vector of embodiment 44, and (ii) a delivery agent.

E46. The composition of embodiment 45, wherein the delivery agent comprises a lipid nanoparticle.

E47. The composition of embodiment 46, wherein the lipid nanoparticle comprises the compound of formula (I).

E48. The composition of any one of embodiments 45 to 47, wherein the delivery agent further comprises a phospholipid.

E49. The composition of any one of embodiments 45 to 48, wherein the delivery agent further comprises a structural lipid.

E50. The composition of embodiment 49, wherein the structural lipid is cholesterol.

E51. The composition of any one of embodiments 45 to 50, wherein the delivery agent further comprises a PEG lipid.

E52. The composition of any one of embodiments 45 to 51, wherein the delivery agent further comprises a quaternary amine compound.

E53. A method of reducing the size of a tumor or inhibiting growth of a tumor in a subject in need thereof comprising administering the polynucleotide of any one of embodiments 1 to 43, the vector of embodiment 44, or the composition of any one of embodiments 45 to 52 in the subject.

E54. The method of embodiment 53, wherein the polynucleotide, vector, or composition is administered subcutaneously, intravenously, intraperitoneally, or intratumorally.

E55. The method of embodiment 53 or 54, wherein the administration treats a cancer.

E56. The method of any one of embodiments 53 to 55, wherein the polynucleotide is administered intratumorally to the subject.

E57. The method of embodiment 56, wherein the polynucleotide is administered at an amount between about 0.10 µg per tumor and about 1000 mg per tumor.

E58. The method of any one of embodiments 53 to 57, further comprising administering an anti-cancer agent.

E59. The method of embodiment 58, wherein the anti-cancer agent comprises (i) an antibody or antigen-binding fragment thereof that specifically binds to PD-1 or PD-L1 (anti-PD-1 antibody or anti-PD-L1 antibody, respectively) or a polynucleotide encoding the anti-PD-1 or anti-PD-L1 antibody or antigen-binding fragment thereof, (ii) an antibody or antigen-binding fragment thereof that specifically binds to CTLA-4 (anti-CTLA-4 antibody) or a polynucleotide encoding the anti-CTLA-4 antibody or antigen-binding fragment thereof, or (iii) an anti-PD-1 or anti-PD-L1 antibody or antigen-binding fragment thereof or a polynucleotide encoding the anti-PD-1 or anti-PD-L1 antibody or antigen-binding fragment thereof, and an anti-CTLA-4 antibody or antigen-binding fragment thereof or a polynucleotide encoding the anti-CTLA-4 antibody or antigen-binding fragment thereof.

E60. The method of embodiment 58 or 59, wherein the administration reduces the size of a tumor or inhibits growth of a tumor at least 1.5 fold, at least 2 fold, at least 2.5 fold, at least 3 fold, at least 3.5 fold, at least 4 fold, at least 4.5 fold, or at least 5 fold better than (i) an administration of a polynucleotide encoding IL12 alone, (ii) an administration of the anti-PD-1 or anti-PD-L1 antibody alone, or (iii) an administration of the anti-CTLA-4 antibody alone.

E61. The method of embodiment 59 or 60, wherein the polynucleotide encoding the anti-PD-1, anti-PD-L1, or anti-CTLA-4 antibody or antigen-binding fragment thereof comprises an mRNA.

E62. The method of any one of embodiments 59 to 61, wherein the polynucleotide encoding the anti-PD-1, anti-PD-L1, or anti-CTLA-4 antibody or antigen-binding fragment thereof comprises at least one chemically modified nucleoside.

E63. The method of embodiment 62, wherein the at least one chemically modified nucleoside is selected from the group consisting of any those listed in Section 13 and a combination thereof.

E64. The method of embodiment 63, wherein the at least one chemically modified nucleoside is selected from the group consisting of pseudouridine, N1-methylpseudouridine, 5-methylcytosine, 5-methoxyuridine, and a combination thereof.

E65. The method of any one of embodiments 62 to 64, wherein the mRNA encoding the anti-PD-1, anti-PD-L1, or anti-CTLA-4 antibody or antigen-binding fragment thereof comprises an open reading frame.

E66. The method of any one of embodiments 59 to 65, wherein the anti-PD-L1 antibody is atezolizumab, avelumab, or durvalumab.

E67. The method of any one of embodiments 59 to 66, wherein the anti-CTLA-4 antibody is tremelimumab or ipilimumab.

32. Equivalents and Scope

Those skilled in the art will recognize, or be able to ascertain using no more than routine experimentation, many equivalents to the specific embodiments in accordance with the disclosure described herein. The scope of the present disclosure is not intended to be limited to the above Description, but rather is as set forth in the appended claims.

In the claims, articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The disclosure includes embodiments in which exactly one member of the group is present in, employed in, or otherwise relevant to a given product or process. The disclosure includes embodiments in which more than one, or all of the group members are present in, employed in, or otherwise relevant to a given product or process.

It is also noted that the term "comprising" is intended to be open and permits but does not require the inclusion of additional elements or steps. When the term "comprising" is used herein, the term "consisting of" is thus also encompassed and disclosed.

Where ranges are given, endpoints are included. Furthermore, it is to be understood that unless otherwise indicated or otherwise evident from the context and understanding of one of ordinary skill in the art, values that are expressed as ranges can assume any specific value or subrange within the stated ranges in different embodiments of the disclosure, to the tenth of the unit of the lower limit of the range, unless the context clearly dictates otherwise.

In addition, it is to be understood that any particular embodiment of the present disclosure that falls within the prior art can be explicitly excluded from any one or more of the claims. Since such embodiments are deemed to be known to one of ordinary skill in the art, they can be excluded even if the exclusion is not set forth explicitly herein. Any particular embodiment of the compositions of the disclosure (e.g., any nucleic acid or protein encoded thereby; any method of production; any method of use; etc.) can be excluded from any one or more claims, for any reason, whether or not related to the existence of prior art.

All cited sources, for example, references, publications, databases, database entries, and art cited herein, are incorporated into this application by reference, even if not expressly stated in the citation. In case of conflicting statements of a cited source and the instant application, the statement in the instant application shall control.

Section and table headings are not intended to be limiting. The present disclosure is further described in the following examples, which do not limit the scope of the disclosure described in the claims.

EXAMPLES

Example 1: In Vitro Expression of Tethered IL-12 mRNA

The in vitro expression of exemplary tethered IL-12 polypeptides encoded by mRNA was assessed. Exemplary schematics of tethered IL-12 polypeptides are shown in FIGS. 1A-1D.

A. Preparation of mRNAs

Polynucleotides were prepared comprising nucleotide sequences encoding a tethered IL-12 polypeptide (murine IL-12) and a miRNA binding site (miR-122) in the 3' UTR. The polynucleotide sequences were: mIL12-8TM (SEQ ID NO: 185), encoding a mouse IL-12 polypeptide connected by a linker to a mouse CD8 transmembrane domain (see FIG. 2A); mIL12-PTM (SEQ ID NO: 183), encoding a mouse IL-12 polypeptide connected by a linker to a mouse PGFRB transmembrane domain (see FIG. 2B); and mIL12-80TM (SEQ ID NO: 181), encoding a mouse IL-12 polypeptide fused to a mouse CD-80 transmembrane domain without a linker (see FIG. 2D). The amino acid sequences encoded by the polynucleotides are shown in SEQ ID NOs: 186, 184 and 182, respectively. The mRNA open reading frame sequences are shown in SEQ ID NOs: 270, 269 and 268, respectively.

A polynucleotide was also prepared comprising a nucleotide sequence encoding a secreted IL-12 polypeptide (murine IL-12) and a miRNA binding site (miR-122) in its 3' UTR (mIL12AB; SEQ ID NO: 267).

B. Expression of Tethered IL-12 mRNAs

HeLa cells were seeded on 6-well plates (BD Biosciences, San Jose, USA) one day prior to transfection. Next, mRNAs comprising mIL12AB, mIL12-8TM, mIL12-PTM, or mIL12-80TM mRNA were individually transfected into the HeLa cells using 2 µg mRNA and 4 µL Lipofectamine 2000 in 150 µL OPTI-MEM per well and incubated. HeLa cells exposed to transfection reagent with no mRNA served as a negative control (i.e., "Mock"). Transfection media was removed after 4 hours and replaced with fresh growth medium for the remainder of the incubation period. After 24 hours, supernatant was collected from each well, and the cells in each well were lysed using a consistent amount of lysis buffer. The amount of IL-12 (ng/well) in the supernatant and lysate for each well was then quantified by a standard ELISA assay.

C. Results

FIG. 3 shows that tethered IL-12 containing a linker between the IL-12 polypeptide and the transmembrane domain (encoded by mIL12-8TM and mIL12-PTM) was highly expressed in lysate, with low levels detectable in the supernatant. Tethered mIL-12 in which the transmembrane domain was fused to the IL-12 polypeptide without a linker (encoded by mIL12-80TM) showed reduced expression in the lysate compared to tethered IL-12 containing the linker.

In contrast to tethered IL-12, FIG. 3 shows that secreted mIL-12 (encoded by mIL12AB) was highly expressed in supernatant and was undetectable in the lysate.

Example 2: In Vitro Induction of CD8+ T Cell Proliferation and Interferon-Gamma (IFNγ) Secretion by Tethered IL-12

The in vitro bioactivity of exemplary tethered IL-12 polypeptides encoded by mRNA was assessed. Specifically, the constructs described in Example 1 were utilized.

A. Preparation of Cultures

CD8+ T cells were isolated from spleens of C57B1/6 mice using the EasySep™ Mouse CD8+ T Cell Isolation Kit (STEMCELL™ Technologies Inc., Vancouver, British Columbia, Canada) according to manufacturer protocols and cultured under standard conditions.

HeLa cell cultures were prepared as described in Example 1, with individual cultures transfected with mIL12AB, mIL12-8TM, mIL12-PTM, or mIL12-80TM mRNA. HeLa cells exposed to transfection reagent with no mRNA served as a negative control ("Mock"). HeLa cells were growth arrested by treating with 50 µg/mL Mitomycin C (Abcam, Cambridge, Mass.) for 20 minutes at 37° C., and washed up to four times with growth medium prior to harvesting and seeding for cultures with T cells.

To assess bioactivity, 50,000 CD8+ T cells were cultured with 25,000 Dynabeads™ Mouse T-Activator CD3/CD28 beads (ThermoFisher Scientific, Waltham, Mass.) and a fixed number of Mitomycin C-treated HeLa cells from a HeLa cell culture transfected with one of the noted constructs and further including a fixed dilution of supernatant from the HeLa cell culture. Recombinant mouse IL-12 (rmIL12) was also added to a subset of negative control cultures ("Mock+rmIL12"). After 72 hours of culture, the proliferation of CD8+ T cells in each culture was determined using the CellTiter-Glo® Luminescent Cell Viability Assay kit (Promega Corporation, Madison, Wis.) according to the manufacturer's instructions, and the amount of IFNγ secreted by the same culture was determined by a standard ELISA assay.

B. Results

FIGS. 4A and 4B show that tethered IL-12 containing a linker between the IL-12 polypeptide and the transmembrane domain (encoded by mIL12-8TM and mIL12-PTM) induced higher levels of CD8+ T cell proliferation and IFNγ secretion in the cultures at 72 hours as compared to tethered IL-12 lacking a linker between the IL-12 polypeptide and the transmembrane domain (encoded by mIL12-80TM).

A separate assay was performed in which the same cultures were produced (excluding cultures with HeLa cells transfected with mIL12-80TM) and analyzed for CD8+ T cell proliferation and IFNγ secretion. FIGS. 4C and 4D show the results of the assay and demonstrate that tethered IL-12 containing a linker between the IL-12 polypeptide and the transmembrane domain (encoded by mIL12-8TM and mIL12-PTM) induced CD8+ T cell proliferation and IFNγ secretion similarly to secreted IL-12 (encoded by mIL12AB).

Example 3: In Vitro Expression and Induction of CD8$^+$ T Cell Proliferation and Interferon-Gamma (IFNγ) Secretion of Tethered IL-12 mRNA The in vitro expression and bioactivity of exemplary tethered IL-12 polypeptides encoded by mRNA was assessed. The constructs described in Example 1, along with additional constructs encoding tethered IL-12 polypeptides were utilized.

A. Preparation of mRNAs

Further to the constructs described in Example 1, the following constructs were prepared: mIL12-80TID (SEQ ID NO: 236), encoding a mouse IL-12 polypeptide connected by a linker to a mouse CD80 transmembrane domain and intracellular domain (see FIG. 2C); and IgK_mscIL12-80TID (SEQ ID NO: 238), encoding the construct described by Wen-Yu Pan et al., Mol Therap, Vol. 20(5): 927-937, May 2012 (see FIG. 2E). The amino acid sequences encoded by the polynucleotides are shown in SEQ ID NOs: 237 and 239, respectively. The mRNA open reading frame sequences are shown in SEQ ID NOs: 271 and 272, respectively.

B. Expression of Tethered IL-12 mRNAs

HeLa cells were cells seeded on 6-well plates (BD Biosciences, San Jose, USA) one day prior to transfection. Next, mRNAs comprising mIL12AB, mIL12-8TM, mIL12-PTM, mIL12-80TM, mIL12-80TID, or IgK_mscIL12-80TID mRNA were individually transfected into the HeLa cells using 2 µg mRNA and 4 µL Lipofectamine 2000 in 150 µL OPTI-MEM per well and incubated. HeLa cells exposed to transfection reagent with no mRNA served as a negative control (i.e., "Mock"). Transfection media was removed after 4 hours and replaced with fresh growth medium for the remainder of the incubation period. After 24 hours, supernatant was collected from each well, and the cells in each well were lysed using a consistent amount of lysis buffer. The amount of IL-12 (ng/well) in the supernatant and lysate for each well was then quantified by a standard ELISA assay.

C. Preparation of Cultures

CD8+ T cells were isolated from spleens of C57B1/6 mice using the EasySep™ Mouse CD8+ T Cell Isolation Kit (STEMCELL™ Technologies Inc., Vancouver, British Columbia, Canada) according to manufacturer protocols and cultured under standard conditions.

HeLa cell cultures were prepared as described in Example 1, with individual cultures transfected with mIL12AB, mIL12-8TM, mIL12-PTM, mIL12-80TM, mIL12-80TID, or IgK_mscIL12-80TID mRNA. HeLa cells exposed to transfection reagent with no mRNA served as a negative control ("Mock"). HeLa cells were growth arrested by treating with 50 µg/mL Mitomycin C (Abcam, Cambridge, Mass.) for 20 minutes at 37° C., and washed up to four times with growth medium prior to harvesting and seeding for cultures with T cells.

To assess bioactivity, 50,000 CD8+ T cells were cultured with 25,000 Dynabeads™ Mouse T-Activator CD3/CD28 beads (ThermoFisher Scientific, Waltham, Mass.) and a fixed number of Mitomycin C-treated HeLa cells from a HeLa cell culture transfected with one of the noted constructs and further including a fixed dilution of supernatant from the HeLa cell culture. Recombinant mouse IL-12 (rmIL12) was also added to a subset of negative control cultures ("Mock+rmIL12"). After 72 hours of culture, the amount of IFNγ secreted in each culture was determined by a standard ELISA assay.

D. Results

FIG. 5A shows expression of IL-12 in the supernatant or lysate, wherein more IL-12 expression was observed in the lysate in cells transfected with mRNA encoding tethered IL-12 polypeptides. FIG. 5B shows induction of IFNγ secretion by the tethered IL-12 polypeptides was similar to induction by recombinant IL-12 protein, thereby confirming the bioactivity of the polypeptides encoded by the mRNA constructs. Notably, the constructs encoding tethered IL-12 polypeptides that include a linker between the IL-12 polypeptide and the transmembrane domain exhibited increased protein expression and IFNγ secretion compared to constructs which lack a linker such as that previously described by Wen-Yu Pan et al and mIL12-80TM.

Example 4: In Vivo Effects of Tethered IL-12 mRNA

The in vivo effects of an exemplary tethered IL-12 polypeptide encoded by mRNA was assessed.

A. Preparation of mRNAs mRNA encoding mIL12-PTM ("tethered mIL-12") or mIL12 ("secreted mIL-12") as described in the above Examples was formulated in PEG-DMG lipid nanoparticles (LNP), comprising Compound 18 as the ionizable amino lipid. See U.S. Patent Pub. 2010/0324120, incorporated herein by reference in its entirety. A negative control mRNA ("NST-OX40L") was prepared comprising a nucleotide sequence encoding mouse OX40L and a miRNA binding site (miR-122) in the 3' UTR, along with multiple stop codons preventing translation of the mRNA (i.e., the sequence encoding OX40L was non-translatable).

B. Mouse Tumor Model

MC38 colon adenocarcinoma tumors were established subcutaneously in C57BL/6 mice by inoculating $5\times10^5$ MC38 tumor cells. Once the tumors reached a mean size of approximately 100 mm$^3$, each animal was treated with a single intratumoral dose (5.0 µg/dose) of either mIL12-PTM mRNA (N=20), mIL12 mRNA (N=20), or NST-OX40L (negative control) mRNA (N=20) formulated in the PEG-DMG lipid nanoparticles.

Plasma levels of IL-12 and IFNγ were measured over time using a Luminex bead-based multi-analyte immunoassay (ThermoFisher Scientific, Waltham, Mass.), along with body weight.

C. Results

FIGS. 6A and 6B show the plasma levels of IL-12 and IFNγ, respectively. Tables 2 and 3 below also provide the plasma levels, along with the secreted:tethered ratio. These results show lower systemic levels of IL-12 and IFNγ with tethered IL-12 polypeptides, which indicates a tolerability benefit.

TABLE 2

| Plasma IL-12 Levels | |
|---|---|
| Treatment | AUC (pg/ml*hr$_{0-168}$) |
| Untreated | 1,090 |
| NST-OX40L | 99 |
| Secreted mIL-12 | 9,496,663 |
| Tethered mIL-12 | 6,534 |
| Secreted: Tethered | Ratio 1448x |

TABLE 3

| Plasma IFNγ Levels | |
|---|---|
| Treatment | AUC (pg/ml*hr$_{0-168}$) |
| Untreated | 2,784 |
| NST-OX40L | 673 |
| Secreted mIL-12 | 1,853,660 |
| Tethered mIL-12 | 180,441 |
| Secreted: Tethered | Ratio 10x |

FIG. 7 shows the percentage of body weight change in mice that received NST-OX40L (negative control), mIL12 (secreted IL-12) or mIL12-PTM (tethered IL-12). These results indicate tethered IL-12 has less impact on body weight compared to secreted IL-12.

Example 5: In Vivo Anti-Tumor Efficacy of Tethered IL-12 mRNA on Treated and Distal Tumors in a Dual Tumor Model The in vivo anti-tumor efficacy of an exemplary tethered IL-12 polypeptide encoded by mRNA was assessed.

A. Preparation of mRNAs mIL12-PTM mRNA was prepared according to Example 4. A negative control mRNA ("NST-OX40L") was prepared comprising a nucleotide sequence encoding mouse OX40L and a miRNA binding site (miR-122) in the 3' UTR, along with multiple stop codons preventing translation of the mRNA (i.e., the sequence encoding OX40L was non-translatable).

B. Mouse Dual Tumor Model

MC38 colon adenocarcinoma tumors were established subcutaneously in C57BL/6 mice by inoculating $5\times10^5$ MC38 tumor cells in both the right (primary) and left (secondary) flanks as shown in FIG. 8A. See also Rosenberg et al., Science 233(4770):1318-21 (1986).

Once the tumors reached a mean size of approximately 100 mm$^3$, the primary tumor in the right flank of each animal was treated with either a single intratumoral dose (5.0 µg/dose) of mIL12-PTM mRNA (N=20) or NST-OX40L (negative control) mRNA (N=20) formulated in PEG-DMG lipid nanoparticles (LNP) prepared according to Example 1. The secondary tumor in the left flank of each animal was not treated.

Tumor volume in the primary tumor and the secondary tumor in each animal was measured using manual calipers at the indicated time points shown in the x-axis of FIGS. 8B-8E. Tumor volume was recorded in cubic millimeters.

C. Results

Intratumoral injection of NST-OX40L negative control mRNA into primary tumors had no effect on tumor volume (see FIG. 8B). Injection of the negative control mRNA in the primary tumor also had no effect on tumor volume of untreated secondary tumors in the same animals (see FIG. 8C).

In contrast, intratumoral injection of IL12-PTM mRNA into primary tumors elicited complete responses (no measurable tumor volume) in the primary tumors of 4 animals and partial responses (with tumor volumes of less than 60 mm$^3$) in the primary tumors of 2 animals (see FIG. 8D). And, a complete response (no measurable tumor volume) was observed in the untreated secondary tumors of 4 animals following injection of IL12-PTM mRNA into the primary tumors of those animals (see FIG. 8E). This result demonstrates that treatment with tethered IL-12 mRNA can produce an abscopal effect on an untreated tumor.

Example 6: In Vitro Expression and Induction of CD8$^+$ T Cell Proliferation and Interferon-Gamma (IFNγ) Secretion of Tethered Human IL-12 mRNA The in vitro expression and bioactivity of exemplary tethered human IL-12 polypeptides encoded by mRNA was assessed.

A. Preparation of mRNAs

Polynucleotides were prepared comprising nucleotide sequences encoding a tethered IL-12 polypeptide (human IL-12) and a miRNA binding site (miR-122) in the 3' UTR. The polynucleotide sequences were: hIL12-8TM (SEQ ID NO: 240), encoding a human IL-12 polypeptide connected by a linker to a human CD8 transmembrane domain, with a V5 tag (see FIG. 9A); hIL12-80TID (SEQ ID NOs: 244-248), encoding a human IL-12 polypeptide connected by a linker to a human CD80 transmembrane and intracellular domain (see FIG. 9B); hIL12-PTID570 (SEQ ID NO: 252), encoding a human IL-12 polypeptide connected by a linker to a human PGFRB transmembrane domain and truncated intracellular domain (E570tr, see amino acid sequence set forth in SEQ ID NO: 227) (see FIG. 9C); and hIL12-PTID739 (SEQ ID NO: 254), encoding a human IL-12 polypeptide connected by a linker to a human PGFRB transmembrane domain and truncated intracellular domain (G739tr, see amino acid sequence set forth in SEQ ID NO: 228) (see FIG. 9D). The amino acid sequences encoded by the polynucleotides are shown in SEQ ID NOs: 241, 249, 253 and 255, respectively. The mRNA open reading frame sequences are shown in SEQ ID NOs: 273, 275-279, 281 and 282, respectively. Each mRNA comprised a 5'UTR having the sequence set forth in SEQ ID NO: 287, and 3'UTR having the sequence set forth in SEQ ID NO: 283.

A polynucleotide was also prepared comprising a nucleotide sequence encoding a secreted IL-12 polypeptide (human IL-12) and a miRNA binding site (miR-122) in its 3' UTR (hIL12AB_041; ORF set forth in SEQ ID NO: 221). Table 4 provides correlating amino acid numbering in SEQ ID NO: 48, nucleotide numbering in SEQ ID NOs: 5-44, and the 5' UTR, IL-12B signal peptide, mature IL-12A and IL-12B peptides, and linker.

TABLE 4

|  | Amino Acids | Nucleotides |
|---|---|---|
| Signal Peptide IL-12B | 1-22 of SEQ ID NO: 48 | 1-66 of SEQ ID NOs: 5-44 |
| Mature IL-12B | 23-328 of SEQ ID NO: 48 | 67-984 of SEQ ID NOs: 5-44 |
| Linker | 329-335 of SEQ ID NO: 48 | 985-1005 of SEQ ID NOs: 5-44 |
| Mature IL-12A | 336-532 of SEQ ID NO: 48 | 1006-1596 of SEQ ID NOs: 5-44 |

B. Expression of Tethered IL-12 mRNAs

HeLa cells were seeded on 6-well plates (BD Biosciences, San Jose, USA) one day prior to transfection. Next, mRNAs comprising hIL12AB_041, hIL12-8TM, hIL12-PTID739, hIL12-PTID570 or hIL12-80TID mRNA were individually transfected into the HeLa cells using 2 µg mRNA and 4 µL Lipofectamine 2000 in 150 µL OPTI-MEM per well and incubated. HeLa cells exposed to transfection reagent with no mRNA served as a negative control (i.e., "Mock"). Transfection media was removed after 4 hours and replaced with fresh growth medium for the remainder of the incubation period. After 24 hours, supernatant was collected from each well, and the cells in each well were lysed using a consistent amount of lysis buffer. The amount of IL-12 (ng/well) in the supernatant and lysate for each well was then quantified by a standard ELISA assay.

C. Preparation of Cultures

Peripheral blood mononuclear cells were prepared from whole human blood by density gradient centrifugation with Lymphoprep™ (STEMCELL™ Technologies Inc., Vancouver, British Columbia, Canada) and SepMate™-50 tubes (STEMCELL™ Technologies Inc., Vancouver, British Columbia, Canada) according to manufacturer protocols. CD8+ T cells were then isolated using the EasySep™ Human CD8+ T Cell Isolation Kit (STEMCELL™ Technologies Inc., Vancouver, British Columbia, Canada) according to manufacturer protocols.

HeLa cell cultures were prepared as described in Example 1, with individual cultures transfected with hIL12AB_002, hIL12-8TM, hIL12-PTID739, hIL12-PTID570 or hIL12-80TID mRNA. HeLa cells exposed to transfection reagent with no mRNA served as a negative control ("Mock"). HeLa cells were growth arrested by treating with 50 µg/mL Mitomycin C (Abcam, Cambridge, Mass.) for 20 minutes at 37° C., and washed up to four times with growth medium prior to harvesting and seeding for cultures with T cells.

To assess bioactivity, 75,000 human peripheral blood CD8+ T cells were cultured with 25,000 Dynabeads™ Human T-Activator CD3/CD28 beads (ThermoFisher Scientific, Waltham, Mass.) and a fixed number of Mitomycin C-treated HeLa cells from a HeLa cell culture transfected with one of the noted constructs and further including a fixed dilution of supernatant from the HeLa cell culture. Recombinant human IL-12 (rhIL12) was also added to a subset of negative control cultures ("Mock+rhIL12"). After 48 hours of culture, the amount of IFNγ secreted in each culture was determined by a standard ELISA assay.

D. Results

FIG. 10A shows expression of IL-12 in the supernatant or lysate, wherein more IL-12 expression was observed in the lysate in cells transfected with mRNA encoding tethered IL-12 polypeptides. FIG. 10B shows induction of IFNγ secretion by the tethered IL-12 polypeptides was similar to induction by recombinant IL-12 protein, thereby confirming the bioactivity of the polypeptides encoded by the mRNA constructs. Tethered constructs demonstrate comparable bioactivity as secreted constructs, while demonstrating almost undetectable IL-12 expression in supernatant. This result suggests that these constructs should also have far lower systemic exposure in vivo than a secreted IL-12, which could provide a tolerability benefit.

Further, FIG. 11 shows expression of hIL12-80TID encoded by four different mRNA sequences (SEQ ID NOs: 276, 277, 278 and 279). These results indicated comparable IL-12 expression in the lysate with minimal expression in the supernatant, regardless of the mRNA used to encode the same amino acid sequence.

OTHER EMBODIMENTS

It is to be understood that the words which have been used are words of description rather than limitation, and that changes can be made within the purview of the appended claims without departing from the true scope and spirit of the disclosure in its broader aspects.

While the present disclosure has been described at some length and with some particularity with respect to the several described embodiments, it is not intended that it should be limited to any such particulars or embodiments or any particular embodiment, but it is to be construed with references to the appended claims so as to provide the broadest possible interpretation of such claims in view of the prior art and, therefore, to effectively encompass the intended scope of the disclosure.

All publications, patent applications, patents, and other references mentioned herein are incorporated by reference in their entirety. In case of conflict, the present specification, including definitions, will control. In addition, section headings, the materials, methods, and examples are illustrative only and not intended to be limiting.

It is to be appreciated that the Detailed Description section, and not the Summary and Abstract sections, is intended to be used to interpret the claims. The Summary and Abstract sections may set forth one or more but not all exemplary embodiments of the present disclosure as contemplated by the inventor(s), and thus, are not intended to limit the present disclosure and the appended claims in any way.

The present disclosure has been described above with the aid of functional building blocks illustrating the implementation of specified functions and relationships thereof. The boundaries of these functional building blocks have been arbitrarily defined herein for the convenience of the description. Alternate boundaries can be defined so long as the specified functions and relationships thereof are appropriately performed.

The foregoing description of the specific embodiments will so fully reveal the general nature of the disclosure that others can, by applying knowledge within the skill of the art, readily modify and/or adapt for various applications such specific embodiments, without undue experimentation, without departing from the general concept of the present disclosure. Therefore, such adaptations and modifications are intended to be within the meaning and range of equivalents of the disclosed embodiments, based on the teaching and guidance presented herein. It is to be understood that the phraseology or terminology herein is for the purpose of description and not of limitation, such that the terminology or phraseology of the present specification is to be interpreted by the skilled artisan in light of the teachings and guidance.

The breadth and scope of the present disclosure should not be limited by any of the above-described exemplary embodiments, but should be defined only in accordance with the following claims and their equivalents.

SUMMARY OF SEQUENCES

| SEQ ID NO | Description | Sequence |
|---|---|---|
| 1 | Wild Type IL12B without signal (IL12B) Amino Acids | IWELKKDVYVVELDWYPDAPGEMVVLTCDTPEEDGITWTLDQSSEVLGSGKTLTIQ VKEFGDAGQYTCHKGGEVLSHSLLLLHKKEDGIWSTDILKDQKEPKNKTFLRCEAK NYSGRFTCWWLTTISTDLTFSVKSSRGSSDPQGVTCGAATLSAERVRGDNKEYEYS VECQEDSACPAAEESLPIEVMVDAVHKLKYENYTSSFFIRDIIKPDPPKNLQLKPL KNSRQVEVSWEYPDTWSTPHSYFSLTFCVQVQGKSKREKKDRVETDKTSATVICRK NASISVRAQDRYYSSSWSEWASVPCS |
| 2 | Wild Type IL12B without signal (IL12B) Nucleic Acids | ATATGGGAACTGAAGAAAGATGTTTATGTCGTAGAATTGGATTGGTATCCGGATGC CCCTGGAGAAATGGTGGTCCTCACCTGTGACACCCCTGAAGAAGATGGTATCACCT GGACCTTGGACCAGAGCAGTGAGGTCTTAGGCTCTGGCAAAACCCTGACCATCCAA GTCAAAGAGTTTGGAGATGCTGGCCAGTACACCTGTCACAAAGGAGGCGAGGTTCT AAGCCATTCGCTCCTGCTGCTTCACAAAAAGGAAGATGGAATTTGGTCCACTGATA TTTTAAAGGACCAGAAAGAACCCAAAAATAAGACCTTTCTAAGATGCGAGGCCAAG AATTATTCTGGACGTTTCACCTGCTGGTGGCTGACGACAATCAGTACTGATTTGAC ATTCAGTGTCAAAAGCAGCAGAGGCTCTTCTGACCCCCAAGGGGTGACGTGCGGAG CTGCTACACTCTCTGCAGAGAGAGTCAGAGGGGACAACAAGGAGTATGAGTACTCA GTGGAGTGCCAGGAGGACAGTGCCTGCCCAGCTGCTGAGGAGAGTCTGCCCATTGA GGTCATGGTGGATGCCGTTCACAAGCTCAAGTATGAAAACTACACCAGCAGCTTCT TCATCAGGGACATCATCAAACCTGACCCACCCAAGAACTTGCAGCTGAAGCCATTA AAGAATTCTCGGCAGGTGGAGGTCAGCTGGGAGTACCCTGACACCTGGAGTACTCC ACATTCCTACTTCTCCCTGACATTCTGCGTTCAGGTCCAGGGCAAGAGCAAGAGAG AAAAGAAAGATAGAGTCTTCACGGACAAGACCTCAGCCACGGTCATCTGCCGCAAA AATGCCAGCATTAGCGTGCGGGCCCAGGACCGCTACTATAGCTCATCTTGGAGCGA ATGGGCATCTGTGCCCTGCAGT |
| 3 | Wild Type IL12A without signal peptide Amino acids | RNLPVATPDPGMFPCLHHSQNLLRAVSNMLQKARQTLEFYPCTSEEIDHEDITKDK TSTVEACLPLELTKNESCLNSRETSFITNGSCLASRKTSFMMALCLSSIYEDLKMY QVEFKTMNAKLLMDPKRQIFLDQNMLAVIDELMQALNFNSETVPQKSSLEEPDFYK TKIKLCILLHAFRIRAVTIDRVMSYLNAS |
| 4 | Wild Type IL12A without signal peptide Nucleic acids | AGAAACCTCCCCGTGGCCACTCCAGACCCAGGAATGTTCCCATGCCTTCACCACTC CCAAAACCTGCTGAGGGCCGTCAGCAACATGCTCCAGAAGGCCAGACAAACTCTAG AATTTTACCCTTGCACTTCTGAAGAGATTGATCATGAAGATATCACAAAAGATAAA ACCAGCACAGTGGAGGCCTGTTTACCATTGGAATTAACCAAGAATGAGAGTTGCCT AAATTCCAGAGAGACCTCTTTCATAACTAATGGGAGTTGCCTGGCCTCCAGAAAGA CCTCTTTTATGATGGCCCTGTGCCTTAGTAGTATTTATGAAGACTTGAAGATGTAC CAGGTGGAGTTCAAGACCATGAATGCAAAGCTTCTGATGGATCCTAAGAGGCAGAT CTTTCTAGATCAAAACATGCTGGCAGTTATTGATGAGCTGATGCAGGCCCTGAATT TCAACAGTGAGACTGTGCCACAAAAATCCTCCCTTGAAGAACCGGATTTTTATAAA ACTAAAATCAAGCTCTGCATACTTCTTCATGCTTTCAGAATTCGGGCAGTGACTAT TGATAGAGTGATGAGCTATCTGAATGCTTCC |
| 5 | hIL12AB_001 ORF | ATGTGTCACCAGCAGCTGGTCATTAGCTGGTTTAGCCTTGTGTTCCTGGCCTCCCC CCTTGTCGCTATTTGGGAGCTCAAGAAGGACGTGTACGTGGTGGAGCTGGACTGGT ACCCAGACGCGCCCGGAGAGATGGTAGTTCTGACCTGTGATACCCCAGAGGAGGAC GGCATCACCTGGACTCTGGACCAAAGCAGCGAGGTTTTGGGCTCAGGGAAAACGCT GACCATCCAGGTGAAGGAATTCGGCGACGCCGGACAGTACACCTGCCATAAGGGAG GAGAGGTGCTGAGCCATTCCCTTCTTCTGCTGCACAAGAAAGAGGACGGCATCTGG TCTACCGACATCCTGAAAGACCAGAAGGAGCCCAAGAACAAAACCTTCCTGAGGTG CGAGGCCAAGAACTACTCCGGCAGGTTCACTTGTTGGTGGCTGACCACCATCAGTA CAGACCTGACTTTTAGTGTAAAAAGCTCCAGAGGCTCGTCCGATCCCAAGGGGTG ACCTGCGGCGCAGCCACTCTGAGCGCTGAGCGCGTGCGCGGTGACAATAAAGAGTA CGAGTACAGCGTTGAGTGTCAAGAAGACAGCGCTTGCCCTGCCGCCGAGGAGAGCC TGCCTATCGAGGTGATGGTTGACGCAGTGCACAAGCTTAAGTACGAGAATTACACC AGCTCATTCTTCATTAGAGATATAATCAAGCCTGACCCACCCAAGAACCTGCAGCT GAAGCCACTGAAAAACTCACGGCAGGTCGAAGTGAGCTGGGAGTACCCCGACACCT GGAGCACTCCTCATTCCTATTTCTCTCTTACATTCTGCGTCCAGGTGCAGGGCAAG AGCAAGCGGGAAAAGAAGGATCGAGTCTTCACCGACAAAACAAGCGCGACCGTGAT TTGCAGGAAGAACGCCAGCATCTCCGTCAGAGCCCAGGATAGATACTATAGTAGCA GCTGGAGCGAGTGGGCAAGCGTGCCCTGTTCCGGCGGCGGGGGCGGGGGCAGCCGA |

SUMMARY OF SEQUENCES

| SEQ ID NO | Description | Sequence |
|---|---|---|
| | | AACTTGCCTGTCGCTACCCCGGACCCTGGAATGTTTCCGTGTCTGCACCACAGCCA GAACCTGCTGAGAGCCGTGTCGAATATGCTCCAGAAGGCCCGGCAGACCCTTGAGT TCTACCCCTGTACCAGCGAAGAGATCGATCATGAGGACATCACGAAAGACAAGACT TCCACCGTCGAGGCTTGTCTCCCGCTGGAGCTGACCAAGAACGAGAGCTGTCTGAA TAGCCGGGAGACATCTTTCATCACGAATGGTAGCTGTCTGGCCAGCAGGAAAACTT CCTTCATGATGGCTCTCTGCCTGAGCTCTATCTATGAAGATCTGAAGATGTATCAG GTGGAGTTTAAGACTATGAACGCCAAACTCCTGATGGACCCAAAAAGGCAAATCTT TCTGGACCAGAATATGCTGGCCGTGATAGACGAGCTGATGCAGGCACTGAACTTCA ACAGCGAGACAGTGCCACAGAAATCCAGCCTGGAGGAGCCTGACTTTTACAAAACT AAGATCAAGCTGTGTATCCTGCTGCACGCCTTTAGAATCCGTGCCGTGACTATCGA CAGGGTGATGTCATACCTCAACGCTTCA |
| 6 | hIL12AB_002 ORF | ATGTGCCACCAGCAGCTGGTGATCAGCTGGTTCAGCCTGGTGTTCCTGGCCAGCCC CCTGGTGGCCATCTGGGAGCTGAAGAAGGACGTGTACGTGGTGGAGCTGGACTGGT ACCCCGACGCCCCCGGCGAGATGGTGGTGCTGACCTGCGACACCCCCGAGGAGGAC GGCATCACCTGGACCCTGGACCAGAGCAGCGAGGTGCTGGGCAGCGGCAAGACCCT GACCATCCAGGTGAAGGAGTTCGGCGACGCCGGCCAGTACACCTGCCACAAGGGCG GCGAGGTGCTGAGCCACAGCCTGCTGCTGCTGCACAAGAAGGAGGACGGCATCTGG AGCACCGACATCCTGAAGGACCAGAAGGAGCCCAAGAACAAGACCTTCCTGAGATG CGAGGCCAAGAACTACAGCGGCAGATTCACCTGCTGGTGGCTGACCACCATCAGCA CCGACCTGACCTTCAGCGTGAAGAGCAGCAGAGGCAGCAGCGACCCCCAGGGCGTG ACCTGCGGCGCCGCCACCCTGAGCGCCGAGAGAGTGAGAGGCGACAACAAGGAGTA CGAGTACAGCGTGGAGTGCCAGGAGGACAGCGCCTGCCCCGCCGCCGAGGAGAGCC TGCCCATCGAGGTGATGGTGGACGCCGTGCACAAGCTGAAGTACGAGAACTACACC AGCAGCTTCTTCATCAGAGACATCATCAAGCCCGACCCCCCCAAGAACCTGCAGCT GAAGCCCCTGAAGAACAGCAGACAGGTGGAGGTGAGCTGGGAGTACCCCGACACCT GGAGCACCCCCCACAGCTACTTCAGCCTGACCTTCTGCGTGCAGGTGCAGGGCAAG AGCAAGAGAGAGAAGAAGGACAGAGTGTTCACCGACAAGACCAGCGCCACCGTGAT CTGCAGAAAGAACGCCAGCATCAGCGTGAGAGCCCAGGACAGATACTACAGCAGCA GCTGGAGCGAGTGGGCCAGCGTGCCCTGCAGCGGCGGCGGCGGCGGCGGCAGCAGA AACCTGCCCGTGGCCACCCCCGACCCCGGCATGTTCCCCTGCCTGCACCACAGCCA GAACCTGCTGAGAGCCGTGAGCAACATGCTGCAGAAGGCCAGACAGACCCTGGAGT TCTACCCCTGCACCAGCGAGGAGATCGACCACGAGGACATCACCAAGGACAAGACC AGCACCGTGGAGGCCTGCCTGCCCCTGGAGCTGACCAAGAACGAGAGCTGCCTGAA CAGCAGAGAGACCAGCTTCATCACCAACGGCAGCTGCCTGGCCAGCAGAAAGACCA GCTTCATGATGGCCCTGTGCCTGAGCAGCATCTACGAGGACCTGAAGATGTACCAG GTGGAGTTCAAGACCATGAACGCCAAGCTGCTGATGGACCCCAAGAGACAGATCTT CCTGGACCAGAACATGCTGGCCGTGATCGACGAGCTGATGCAGGCCCTGAACTTCA ACAGCGAGACCGTGCCCCAGAAGAGCAGCCTGGAGGAGCCCGACTTCTACAAGACC AAGATCAAGCTGTGCATCCTGCTGCACGCCTTCAGAATCAGAGCCGTGACCATCGA CAGAGTGATGAGCTACCTGAACGCCAGC |
| 7 | hIL12AB_003 ORF | ATGTGTCACCAGCAGTTGGTCATCTCTTGGTTTTCCCTGGTTTTTCTGGCATCTCC CCTCGTGGCCATATGGGAACTGAAGAAAGATGTTTATGTCGTAGAATTGGATTGGT ATCCGGATGCCCCTGGAGAAATGGTGGTCCTCACCTGTGACACCCCTGAAGAAGAT GGTATCACCTGGACCTTGGACCAGAGCAGTGAGGTCTTAGGCTCTGGCAAAACCCT GACCATCCAAGTCAAAGAGTTTGGAGATGCTGGCCAGTACACCTGTCACAAGGGAG GCGAGGTTCTAAGCCATTCGCTCCTGCTGCTTCACAAAAAGGAAGATGGAATTTGG TCCACTGATATTTTAAAGGACCAGAAAGAACCCAAAAATAAGACCTTTCTAAGATG CGAGGCCAAGAATTATTCTGGACGTTTCACCTGCTGGTGGCTGACGACAATCAGTA CTGATTTGACATTCAGTGTCAAAAGCAGCAGAGGCTCTTCTGACCCCAAGGGGTG ACGTGCGGAGCTGCTACACTCTCTGCAGAGAGTCAGAGGGGACAACAAGGAGTA TGAGTACTCAGTGGAGTGCCAGGAGGACAGTGCCTGCCCAGCTGCTGAGGAGAGTC TGCCCATTGAGGTCATGGTGGATGCCGTTCACAAGCTCAAGTATGAAAACTACACC AGCAGCTTCTTCATCAGGGACATCATCAAACCTGACCCACCCAAGAACTTGCAGCT GAAGCCATTAAAGAATTCTCGGCAGGTGGAGGTCAGCTGGGAGTACCCCTGACACCT GGAGTACTCCACATTCCTACTTCTCCCTGACATTCTGCGTTCAGGTCCAGGGCAAG AGCAAGAGAGAAAGAAAGATAGAGTCTTCACGGACAAGACCTCAGCCACGGTCAT CTGCCGCAAAAATGCCAGCATTAGCGTGCGGGCCCAGGACCGCTACTATAGCTCAT CTTGGAGCGAATGGGCATCTGTGCCCTGCAGTGGCGGAGGGGGCGGAGGGAGCAGA AACCTCCCCGTGGCCACTCCAGACCCAGGAATGTTCCCATGCCTTCACCACTCCCA AAACCTGCTGAGGGCCGTCAGCAACATGCTCCAGAAGGCCAGACAAACTTTAGAAT TTTACCCTTGCACTTCTGAAGAGATTGATCATGAAGATATCACAAAAGATAAACC AGCACAGTGGAGGCCTGTTTACCATTGGAATTAACCAAGAATGAGAGTTGCCTAAA TTCCAGAGAGACCTCTTTCATAACTAATGGGAGTTGCCTGGCCTCCAGAAAGACCT CTTTTATGATGGCCCTGTGCCTTAGTAGTATTTATGAAGACTTGAAGATGTACCAG GTGGAGTTCAAGACCATGAATGCAAAGCTTCTGATGGATCCTAAGAGGCAGATCTT TTTAGATCAAAACATGCTGGCAGTTATTGATGAGCTGATGCAGGCCCTGAATTTCA ACAGTGAGACTGTGCCACAAAAATCCTCCCTTGAAGAACCGGACTTCTACAAGACC AAGATCAAGCTCTGCATACTTCTTCATGCTTTCAGAATTCGGGCAGTGACTATTGA TAGAGTGATGAGCTATCTGAATGCTTCC |

-continued

SUMMARY OF SEQUENCES

| SEQ ID NO | Description | Sequence |
|---|---|---|
| 8 | hIL12AB_004 ORF | ATGGGCTGCCACCAGCAGCTGGTCATCAGCTGGTTCTCCCTGGTCTTCCTGGCCAG<br>CCCCCTGGTGGCCATCTGGGAGCTGAAGAAAGATGTCTATGTTGTAGAGCTGGACT<br>GGTACCCAGATGCTCCTGGAGAAATGGTGGTTCTCACCTGTGACACGCCAGAAGAA<br>GATGGCATCACCTGGACGCTGGACCAGAGCTCAGAAGTTCTTGGCAGTGGAAAAAC<br>GCTGACCATACAAGTAAAAGAATTTGGGGATGCTGGCCAGTACACCTGCCACAAAG<br>GAGGAGAAGTTCTCAGCCACAGCCTGCTGCTGCTGCACAAGAAAGAAGATGGCATC<br>TGGAGCACAGACATTTTAAAAGACCAGAAGGAGCCCAAGAACAAAACCTTCCTTCG<br>ATGTGAGGCCAAGAACTACAGTGGCCGCTTCACCTGCTGGTGGCTCACCACCATCA<br>GCACAGACCTCACCTTCTCGGTGAAGAGCAGCCGTGGCAGCTCAGACCCCCAAGGA<br>GTCACCTGTGGGGCGGCCACGCTGTCGGCAGAAAGAGTTCGAGGGGACAACAAGGA<br>ATATGAATACTCGGTGGAATGTCAAGAAGACTCGGCCTGCCCGGCGGCAGAAGAAA<br>GTCTTCCCATAGAAGTCATGGTGGATGCTGTTCACAAATTAAAATATGAAAACTAC<br>ACCAGCAGCTTCTTCATCAGAGACATCATCAAGCCAGACCCGCCCAAGAACCTGCA<br>GCTGAAGCCCCTGAAGAACAGCAGACAAGTGGAAGTTTCCTGGGAGTACCCAGACA<br>CGTGGAGCACGCCGCACAGCTACTTCAGCCTCACCTTCTGTGTACAAGTACAAGGC<br>AAGAGCAAGAGAGAAGAAAGATCGTGTCTTCACAGACAAAACCTCGGCGACGGT<br>CATCTGCAGGAAGAATGCCTCCATCTCGGTTCGAGCCCAGGACCGCTACTACAGCA<br>GCAGCTGGAGTGAGTGGGCCTCGGTGCCCTGCAGTGGTGGCGGCGGCGGCGGCAGC<br>AGAAACCTTCCTGTGGCCACGCCGGACCCTGGCATGTTCCCGTGCCTGCACCACAG<br>CCAAAATTTACTTCGAGCTGTTTCTAACATGCTGCAGAAAGCAAGACAAACTTTAG<br>AATTCTACCCCTGCACCTCAGAAGAAATAGACCATGAAGACATCACCAAAGATAAA<br>ACCAGCACTGTAGAGGCCTGCCTGCCCCTGGAGCTCACCAAGAATGAATCCTGCCT<br>CAACAGCAGAGAGACCAGCTTCATCACCAATGGCAGCTGCCTGGCCAGCAGGAAAA<br>CCAGCTTCATGATGGCGCTCTGCCTGAGCAGCATCTATGAAGATTTGAAGATGTAC<br>CAAGTAGAATTTAAAACCATGAATGCCAAGCTGCTCATGGACCCCAAGAGACAAAT<br>ATTTTTGGATCAAAACATGCTGGCTGTCATTGATGAGCTCATGCAAGCATTAAACT<br>TCAACTCAGAGACGGTGCCCCAGAAGAGCAGCCTGGAGGAGCCAGACTTCTACAAA<br>ACCAAGATCAAGCTCTGCATCTTATTACATGCCTTCCGCATCCGGGCGGTCACCAT<br>TGACCGTGTCATGTCCTACTTAAATGCCAGC |
| 9 | hIL12AB_005 ORF | ATGTGCCACCAGCAGCTGGTCATCAGCTGGTTCTCCCTGGTCTTCCTGGCCAGCCC<br>CCTGGTGGCCATCTGGGAGCTGAAGAAAGATGTCTATGTTGTAGAGCTGGACTGGT<br>ACCCAGATGCTCCTGGAGAAATGGTGGTTCTCACCTGTGACACGCCAGAAGAAGAT<br>GGCATCACCTGGACGCTGGACCAGAGCTCAGAAGTTCTTGGCAGTGGAAAAACGCT<br>GACCATACAAGTAAAAGAATTTGGGGATGCTGGCCAGTACACCTGCCACAAAGGAG<br>GAGAAGTTCTCAGCCACAGCCTGCTGCTGCTGCACAAGAAAGAAGATGGCATCTGG<br>AGCACAGACATTTTAAAAGACCAGAAGGAGCCCAAGAACAAAACCTTCCTTCGATG<br>TGAGGCCAAGAACTACAGTGGCCGCTTCACCTGCTGGTGGCTCACCACCATCAGCA<br>CAGACCTCACCTTCTCGGTGAAGAGCAGCCGTGGCAGCTCAGACCCCCAAGGAGTC<br>ACCTGTGGGCGGCCACGCTGTCGGCAGAAAGAGTTCGAGGGGACAACAAGGAATA<br>TGAATACTCGGTGGAATGTCAAGAAGACTCGGCCTGCCCGGCGGCAGAAGAAAGTC<br>TTCCCATAGAAGTCATGGTGGATGCTGTTCACAAATTAAAATATGAAAACTACACC<br>AGCAGCTTCTTCATCAGAGACATCATCAAGCCAGACCCGCCCAAGAACCTGCAGCT<br>GAAGCCCCTGAAGAACAGCAGACAAGTGGAAGTTTCCTGGGAGTACCCAGACACGT<br>GGAGCACGCCGCACAGCTACTTCAGCCTCACCTTCTGTGTACAAGTACAAGGCAAG<br>AGCAAGAGAGAAGAAAGATCGTGTCTTCACAGACAAAACCTCGGCGACGGTCAT<br>CTGCAGGAAGAATGCCTCCATCTCGGTTCGAGCCCAGGACCGCTACTACAGCAGCA<br>GCTGGAGTGAGTGGGCCTCGGTGCCCTGCAGTGGTGGCGGCGGCGGCGGCAGCAGA<br>AACCTTCCTGTGGCCACGCCGGACCCTGGCATGTTCCCGTGCCTGCACCACAGCCA<br>AAATTTACTTCGAGCTGTTTCTAACATGCTGCAGAAAGCAAGACAAACTTTAGAAT<br>TCTACCCCTGCACCTCAGAAGAAATAGACCATGAAGACATCACCAAAGATAAAACC<br>AGCACTGTAGAGGCCTGCCTGCCCCTGGAGCTCACCAAGAATGAATCCTGCCTCAA<br>CAGCAGAGAGACCAGCTTCATCACCAATGGCAGCTGCCTGGCCAGCAGGAAAACCA<br>GCTTCATGATGGCGCTCTGCCTGAGCAGCATCTATGAAGATTTGAAGATGTACCAA<br>GTAGAATTTAAAACCATGAATGCCAAGCTGCTCATGGACCCCAAGAGACAAATATT<br>TTTGGATCAAAACATGCTGGCTGTCATTGATGAGCTCATGCAAGCATTAAACTTCA<br>ACTCAGAGACGGTGCCCCAGAAGAGCAGCCTGGAGGAGCCAGACTTCTACAAAACC<br>AAGATCAAGCTCTGCATCTTATTACATGCCTTCCGCATCCGGGCGGTCACCATTGA<br>CCGTGTCATGTCCTACTTAAATGCCAGC |
| 10 | hIL12AB_006 ORF | ATGTGCCACCAGCAGCTGGTGATCAGCTGGTTCAGCCTGGTGTTCCTGGCCAGCCC<br>CCTGGTGGCCATCTGGGAGCTGAAGAAGGACGTGTACGTGGTGGAGCTGGACTGGT<br>ACCCCGACGCCCCGGCGAGATGGTGGTGCTGACCTGTGACACCCCCGAGGAGGAC<br>GGCATCACCTGGACCCTGGACCAGAGCAGCGAGGTGCTGGGCAGCGGCAAGACCCT<br>GACCATCCAGGTGAAGGAGTTCGGGGACGCCGGCCAGTACACCTGCCACAAGGGCG<br>GCGAGGTGCTGAGCCACAGCCTGCTGCTGCTGCACAAGAAGGAGGACGGCATCTGG<br>AGCACAGATATCCTGAAGGACCAGAAGGAGCCCAAGAACAAGACCTTCCTGAGATG<br>CGAGGCCAAGAACTACAGCGGCAGATTCACCTGCTGGTGGCTGACCACCATCAGCA<br>CAGACTTGACCTTCAGCGTGAAGAGCAGCAGAGGCAGCAGCGACCCCCAGGGCGTG<br>ACCTGCGGCGCCGCCACCCTGAGCGCCGAGAGAGTGAGAGGGGACAACAAGGAGTA<br>CGAGTACAGCGTGGAGTGCCAGGAGGACAGCGCCTGCCCCGCCGCCGAGGAGAGCC<br>TGCCCATCGAGGTGATGGTGGACGCCGTGCACAAGCTGAAGTACGAGAACTACACC<br>AGCAGCTTCTTCATCAGAGACATCATCAAGCCCGACCCGCCGAAGAACCTGCAGCT |

SUMMARY OF SEQUENCES

| SEQ ID NO | Description | Sequence |
|---|---|---|
| | | GAAGCCCTGAAGAACAGCAGACAGGTGGAGGTGAGCTGGGAGTACCCCGACACCT GGAGCACCCCCACAGCTACTTCAGCCTGACCTTCTGCGTGCAGGTGCAGGGCAAG AGCAAGAGAGAGAAGAAGGACAGAGTGTTCACAGATAAGACCAGCGCCACCGTGAT CTGCAGAAAGAACGCCAGCATCAGCGTGAGAGCCCAGGACAGATACTACAGCAGCA GCTGGAGCGAGTGGGCCAGCGTGCCCTGCAGCGGCGGCGGCGGCGGCGGCAGCAGA AACCTGCCCGTGGCCACCCCCGACCCCGGCATGTTCCCCTGCCTGCACCACAGCCA GAACCTGCTGAGAGCCGTGAGCAACATGCTGCAGAAGGCCAGACAGACCCTGGAGT TCTACCCCTGCACCAGCGAGGAGATCGACCACGAGGACATCACCAAGGACAAGACC AGCACCGTGGAGGCCTGCCTGCCCCTGGAGCTGACCAAGAATGAAAGCTGCCTGAA CAGCAGAGAGACCAGCTTCATCACCAACGGCAGCTGCCTGGCCAGCAGAAAGACCA GCTTCATGATGGCCCTGTGCCTGAGCAGCATCTACGAGGACCTGAAGATGTACCAG GTGGAGTTCAAGACCATGAACGCCAAGCTGCTGATGGACCCCAAGAGACAGATCTT CCTGGACCAGAACATGCTGGCCGTGATCGACGAGCTGATGCAGGCCCTGAACTTCA ACAGCGAGACCGTGCCCCAGAAGAGCAGCCTGGAGGAGCCCGACTTCTACAAGACC AAGATCAAGCTGTGCATCCTGCTGCACGCCTTCAGAATCAGAGCCGTGACCATCGA CAGAGTGATGAGCTACCTGAACGCCAGC |
| 11 | hIL12AB_007 ORF | ATGTGCCACCAGCAGCTTGTCATCTCCTGGTTCTCTCTTGTCTTCCTTGCTTCTCC TCTTGTGGCCATCTGGGAGCTGAAGAAGGATGTTTATGTTGTGGAGTTGGACTGGT ACCCTGATGCTCCTGGAGAAATGGTGGTTCTCACCTGTGACACTCCTGAGGAGGAT GGCATCACCTGGACTTTGGACCAGTCTTCTGAGGTTCTTGGCAGTGGAAAAACTCT TACTATTCAGGTGAAGGAGTTTGGAGATGCTGGCCAGTACACCTGCCACAAGGGTG GTGAAGTTCTCAGCCACAGTTTACTTCTTCTTCACAAGAAGGAGGATGGCATCTGG TCTACTGACATTTTAAAAGACCAGAAGGAGCCCAAGAACAAGACTTTCCTTCGTTG TGAAGCCAAGAACTACAGTGGTCGTTTCACCTGCTGGTGGCTTACTACTATTTCTA CTGACCTTACTTTCTCTGTGAAGTCTTCTCGTGGCTCTTCTGACCCTCAGGGTGTC ACCTGTGGGGCTGCTACTCTTTCTGCTGAGCGTGTGCGTGGGGACAACAAGGAGTA TGAATACTCGGTGGAGTGCCAGGAGGACTCTGCCTGCCCTGCTGCTGAGGAGTCTC TTCCTATTGAGGTGATGGTGGATGCTGTGCACAAGTTAAAATATGAAAACTACACT TCTTCTTTCTTCATTCGTGACATTATAAAACCTGACCCTCCCAAGAACCTTCAGTT AAAACCTTTAAAAAACTCTCGTCAGGTGGAGGTGTCCTGGGAGTACCCTGACACGT GGTCTACTCCTCACTCCTACTTCTCTCTTACTTTCTGTGTCCAGGTGCAGGGCAAG TCCAAGCGTGAGAAGAAGGACCGTGTCTTCACTGACAAGACTTCTGCTACTGTCAT CTGCAGGAAGAATGCATCCATCTCTGTGCGTGCTCAGGACCGTTACTACAGCTCTT CCTGGTCTGAGTGGGCTTCTGTGCCCTGCTCGGCGGCGGCGGCGGCGGCAGCAGA AATCTTCCTGTGGCTACTCCTGACCCTGGCATGTTCCCCTGCCTTCACCACTCGCA GAACCTTCTTCGTGCTGTGAGCAACATGCTTCAGAAGGCTCGTCAGACTTTAGAAT TCTACCCCTGCACTTCTGAGGAGATTGACCATGAAGACATCACCAAGGACAAGACT TCTACTGTGGAGGCCTGCCTTCCTTTAGAGCTGACCAAGAATGAATCCTGCTTAAA TTCTCGTGAGACTTCTTTCATCACCAATGGCAGCTGCCTTGCCTCGCGCAAGACTT CTTTCATGATGGCTCTTTGCCTTTCTTCCATCTATGAAGACTTTAAAAATGTACCAG GTGGAGTTCAAGACCATGAATGCAAAGCTTCTCATGGACCCCAAGCGTCAGATATT TTTGGACCAGAACATGCTTGCTGTCATTGATGAGCTCATGCAGGCTTTAAACTTCA ACTCTGAGACTGTGCCTCAGAAGTCTTCTTTAGAAGAGCCTGACTTCTACAAGACC AAGATAAAACTTTGCATTCTTCTTCATGCTTTCCGCATCCGTGCTGTGACTATTGA CCGTGTGATGTCCTACTTAAATGCTTCT |
| 12 | hIL12AB_008 ORF | ATGTGTCATCAACAACTCGTGATTAGCTGGTTCAGTCTCGTGTTCCTGGCCTCTCC GCTGGTGGCCATCTGGGAGCTTAAGAAGGACGTGTACGTGGTGGAGCTCGATTGGT ACCCCGATGCTCCTGGCGAGATGGTGGTGCTAACCTGCGATACCCCCGAGGAGGAC GGGATCACTTGGACCCTTGGATCAGAGTAGCGAAGTCCTGGGCTCTGGCAAGACACT CACAATCCAGGTGAAGGAATTCGGAGACGCTGGTCAGTACACTTGCCACAAGGGGG GTGAAGTGCTGTCTCACAGCCTGCTGTTACTGCACAAGAAGGAGGATGGGATCTGG TCAACCGACATCCTGAAGGATCAGAAGGAGCCTAAGAACAAGACCTTTCTGAGGTG TGAAGCTAAGAACTATTCCGGAAGATTCACTTGCTGGTGGTTGACCACAATCAGCA CTGACCTGACCTTTTCCGTGAAGTCCAGCAGAGGAAGCAGCGATCCTCAGGGCGTA ACGTGCGGCGCGGCTACCCTGTCAGCTGAGCGGGTTAGAGGCGACAACAAAGAGTA TGAGTACTCCGTGGAGTGTCAGGAGGACAGCGCCTGCCCCGCAGCCGAGGAGAGTC TGCCCATCGAGGTGATGGTGGACGCTGTCCATAAGTTAAAATACGAAAATTACACA AGTTCCTTTTTCATCCGCGATATTATCAAACCCGATCCCCCCAAGAACCTGCAGCT GAAGCCCCTGAAGAATAGCCGACAGGTGGAAGTCTCTTGGGAGTATCCTGACACCT GGTCCACGCCTCACAGCTACTTTAGTCTGACTTTCTGTGTCCAGGTCCAGGGCAAG AGCAAGAGAGAGAAAAAGGATAGAGTGTTTACTGACAAGACATCTGCTACAGTCAT CTGCAGAAAGAACGCCAGTATCTCAGTGAGGGCGCAGGACAGATACTACAGTAGTA GCTGGAGCGAATGGGCTAGCGTGCCCTGTTCAGGGGCGCGGAGGGGCTCCAGG AATCTGCCCGTGGCCACCCCCGACCCTGGGATGTTCCCTTGCCTCCATCACTCACA GAACCTGCTCAGAGCAGTGAGCAACATGCTCCAAAAGGCCCGCCAGACCCTGGAGT TTTACCCTTGTACTTCAGAAGAGATCGATCACGAAGACATAACAAAGGATAAAACC AGCACCGTGGAGGCCTGTCTGCCTCTAGAACTCACAAAGAATGAAAGCTGTCTGAA TTCCAGGGAAACCTCCTTCATTACTAACGGAAGCTGTCTCGCATCTCGCAAAACAT CATTCATGATGGCCCTCTGCCTGTCTTCTATCTATGAAGATCTCAAGATGTATCAG GTGGAGTTCAAAACAATGAACGCCAAGCTGCTGATGGACCCCAAGAGACAGATCTT CCTGGACCAGAACATGCTGGCAGTGATCGATGAGCTGATGCAAGCCTTGAACTTCA |

SUMMARY OF SEQUENCES

| SEQ ID NO | Description | Sequence |
|---|---|---|
| | | ACTCAGAGACAGTGCCGCAAAAGTCCTCGTTGGAGGAACCAGATTTTTACAAAACC<br>AAAATCAAGCTGTGTATCCTTCTTCACGCCTTTCGGATCAGAGCCGTGACTATCGA<br>CCGGGTGATGTCATACCTGAATGCTTCC |
| 13 | hIL12AB_009 ORF | ATGTGCCACCAGCAGCTGGTCATCAGCTGGTTTAGCCTGGTCTTCCTGGCCAGCCC<br>CCTGGTGGCCATCTGGGAGCTGAAGAAAGATGTCTATGTTGTAGAGCTGGACTGGT<br>ACCCAGATGCTCCTGGAGAAATGGTGGTTCTCACCTGCGACACGCCAGAAGAAGAT<br>GGCATCACCTGGACGCTGGACCAGAGCAGCGAAGTACTGGGCAGTGGAAAAACGCT<br>GACCATACAAGTAAAAGAATTTGGCGATGCTGGCCAGTACACCTGCCACAAAGGAG<br>GAGAAGTACTGAGCCACAGCCTGCTGCTGCTGCACAAGAAAGAAGATGGCATCTGG<br>AGCACCGACATTTTAAAAGACCAGAAGGAGCCCAAGAACAAAACCTTCCTTCGATG<br>TGAGGCGAAGAACTACAGTGGCCGCTTCACCTGCTGGTGGCTCACCACCATCAGCA<br>CCGACCTCACCTTCTCGGTGAAGAGCAGCCGTGGTAGCTCAGACCCCCAAGGAGTC<br>ACCTGTGGGCGGCCACGCTGTCGGCAGAAAGAGTTCGAGGCGACAACAAGGAATA<br>TGAATACTCGGTGGAATGTCAAGAAGACTCGGCCTGCCCGGCGGCAGAAGAAAGTC<br>TGCCCATAGAAGTCATGGTGGATGCTGTTCACAAATTAAAATATGAAAACTACACC<br>AGCAGCTTCTTCATCAGAGACATCATCAAGCCAGACCCCCCCAAGAACCTGCAGCT<br>GAAGCCCCTGAAGAACAGCAGACAAGTGGAAGTTTCCTGGGAGTACCCAGACACGT<br>GGAGCACGCCGCACAGCTACTTCAGCCTCACCTTCTGTGTACAAGTACAAGGCAAG<br>AGCAAGAGAGAGAAGAAAGATCGTGTCTTCACCGACAAAACCTCGGCGACGGTCAT<br>CTGCAGGAAGAATGCAAGCATCTCGGTTCGAGCCCAGGACCGCTACTACAGCAGCA<br>GCTGGAGTGAGTGGGCCTCGGTGCCCTGCAGTGGTGGCGGCGGCGGCGGCAGCAGA<br>AACCTTCCTGTGGCCACGCCGGACCCTGGCATGTTTCCGTGCCTGCACCACAGCCA<br>AAATTTATTACGAGCTGTTAGCAACATGCTGCAGAAAGCAAGACAAACTTTAGAAT<br>TCTACCCCTGCACCTCAGAAGAAATAGACCATGAAGACATCACCAAAGATAAAACC<br>AGCACTGTAGAGGCCTGCCTGCCCCTGGAGCTCACCAAGAACGAGAGCTGCCTCAA<br>TAGCAGAGAGACCAGCTTCATCACCAATGGCAGCTGCCTGGCCAGCAGGAAAACCA<br>GCTTCATGATGGCGCTCTGCCTGAGCAGCATCTATGAAGATCTGAAGATGTACCAA<br>GTAGAATTTAAAACCATGAATGCCAAGCTGCTCATGGACCCCAAGAGACAAATATT<br>CCTCGACCAAAACATGCTGGCTGTCATTGATGAGCTCATGCAAGCATTAAACTTCA<br>ACTCAGAGACGGTGCCCCAGAAGAGCAGCCTGGAGGAGCCAGACTTCTACAAAACC<br>AAGATCAAGCTCTGCATCTTATTACATGCCTTCCGCATCCGGGCGGTCACCATTGA<br>CCGTGTCATGTCCTACTTAAATGCCAGC |
| 14 | hIL12AB_010 ORF | ATGTGCCACCAGCAGCTTGTCATCTCCTGGTTTTCTCTTGTCTTCCTCGCTTCTCC<br>TCTTGTGGCCATCTGGGAGCTGAAGAAAGATGTCTATGTTGTAGAGCTGGACTGGT<br>ACCCGGACGCTCCTGGAGAAATGGTGGTTCTCACCTGCGACACTCCTGAAGAAGAT<br>GGCATCACCTGGACGCTGGACCAAAGCAGCGAAGTTTTAGGCTCTGGAAAAACGCT<br>GACCATACAAGTAAAAGAATTTGGCGACGCTGGCCAGTACACGTGCCACAAAGGAG<br>GAGAAGTTTTAAGCCACAGTTTACTTCTTCTTCACAAGAAAGAAGATGGCATCTGG<br>AGTACGGACATTTTAAAAGACCAGAAGGAGCCTAAGAACAAAACCTTCCTCCGCTG<br>TGAAGCTAAGAACTACAGTGGTCGTTTCACCTGCTGGTGGCTCACCACCATCTCCA<br>CTGACCTCACCTTCTCTGTAAAATCAAGCCGTGGTTCTTCTGACCCCCAAGGAGTC<br>ACCTGTGGGCTGCCACGCTCAGCGCTGAAAGAGTTCGAGGCGACAACAAGGAATA<br>TGAATATTCTGTGGAATGTCAAGAAGATTCTGCCTGCCCGGCGGCAGAAGAAAGTC<br>TTCCCATAGAAGTCATGGTGGACGCTGTTCACAAATTAAAATATGAAAACTACACC<br>AGCAGCTTCTTCATTCGTGACATCATCAAACCAGACCCTCCTAAGAACCTTCAGTT<br>AAAACCGCTGAAGAACAGCAGACAAGTGGAAGTTTCCTGGGAGTACCCGGACACGT<br>GGAGTACGCCGCACTCCTACTTCAGTTTAACCTTCTGTGTACAAGTACAAGGAAAA<br>TCAAAAAGAGAGAAGAAAGATCGTGTCTTCACTGACAAAACATCTGCCACGGTCAT<br>CTGCCGTAAGAACGCTTCCATCTCGGTTCGAGCCCAGGACCGCTACTACAGCAGCA<br>GCTGGAGTGAGTGGGCATCTGTTCCCTGCAGTGGTGGCGGCGGCGGCGGCAGCCGC<br>AACCTTCCTGTGGCCACGCCGGACCCTGGCATGTTCCCGTGCCTTCACCACTCGCA<br>AAATCTTCTTCGTGCTGTTTCTAACATGCTGCAGAAGGCGAGACAAACTTTAGAAT<br>TCTACCCGTGCACTTCTGAAGAAATAGACCATGAAGACATCACCAAGGACAAAACC<br>AGCACGGTGGAGGCCTGCCTTCCTTTAGAACTTACTAAGAACGAAAGTTGCCTTAA<br>CAGCCGTGAGACCAGCTTCATCACCAATGGCAGCTGCCTTGCTAGCAGGAAGACCA<br>GCTTCATGATGGCGCTGTGCCTTTCTTCCATCTATGAAGATCTTAAGATGTACCAA<br>GTAGAATTTAAAACCATGAATGCCAAATTATTAATGGACCCCAAGAGACAAATATT<br>CCTCGACCAAAACATGCTGGCTGTCATTGATGAGCTCATGCAAGCATTAAACTTCA<br>ACTCAGAAACTGTTCCCCAGAAGTCATCTTTAGAAGAACCGGACTTCTACAAAACA<br>AAAATAAAACTCTGCATTCTTCTTCATGCCTTCCGCATCCGTGCTGTCACCATTGA<br>CCGTGTCATGTCCTACTTAAATGCTTCT |
| 15 | hIL12AB_011 ORF | ATGTGCCACCAGCAGCTGGTGATCAGCTGGTTCAGCCTGGTGTTCCTGGCCAGCCC<br>CCTGGTGGCCATCTGGGAGCTGAAGAAGGACGTGTACGTGGTGGAGCTGGACTGGT<br>ACCCGGACGCGCCGGGGGAGATGGTGGTGCTGACGTGCGACACGCCGGAGGAGGAC<br>GGGATCACGTGGACGCTGGACCAGAGCAGCGAGGTGCTGGGGAGCGGGAAGACGCT<br>GACGATCCAGGTGAAGGAGTTCGGGGACGCGGGGCAGTACACGTGCCACAAGGGGG<br>GGGAGGTGCTGAGCCACAGCCTGCTGCTGCTGCACAAGAAGGAGGACGGGATCTGG<br>AGCACGGACATCCTGAAGGACCAGAAGGAGCCGAAGAACAAGACGTTCCTGAGGTG<br>CGAGGCGAAGAACTACAGCGGGAGGTTCACGTGCTGGTGGCTGACGACGATCAGCA<br>CGGACCTGACGTTCAGCGTGAAGAGCAGCAGGGGGAGCAGCGACCCCGCAGGGGTG |

SUMMARY OF SEQUENCES

| SEQ ID NO | Description | Sequence |
|---|---|---|
| | | ACGTGCGGGGCGGCGACGCTGAGCGCGGAGAGGGTGAGGGGGGACAACAAGGAGTA<br>CGAGTACAGCGTGGAGTGCCAGGAGGACAGCGCGTGCCCGGCGGCGGAGGAGAGCC<br>TGCCGATCGAGGTGATGGTGGACGCGGTGCACAAGCTGAAGTACGAGAACTACACG<br>AGCAGCTTCTTCATCAGGGACATCATCAAGCCGGACCCGCCGAAGAACCTGCAGCT<br>GAAGCCGCTGAAGAACAGCAGGCAGGTGGAGGTGAGCTGGGAGTACCCGGACACGT<br>GGAGCACGCCGCACAGCTACTTCAGCCTGACGTTCTGCGTGCAGGTGCAGGGGAAG<br>AGCAAGAGGGAGAAGAAGGACAGGGTGTTCACGGACAAGACGAGCGCGACGGTGAT<br>CTGCAGGAAGAACGCGAGCATCAGCGTGAGGGCGCAGGACAGGTACTACAGCAGCA<br>GCTGGAGCGAGTGGGCGAGCGTGCCGTGCAGCGGGGGGGGGGGGGGGGAGCAGG<br>AACCTGCCGGTGGCGACGCCGGACCCGGGGATGTTCCCGTGCCTGCACCACAGCCA<br>GAACCTGCTGAGGGCGGTGAGCAACATGCTGCAGAAGGCGAGGCAGACGCTGGAGT<br>TCTACCCGTGCACGAGCGAGGAGATCGACCACGAGGACATCACGAAGGACAAGACG<br>AGCACGGTGGAGGCGTGCCTGCCGCTGGAGCTGACGAAGAACGAGAGCTGCCTGAA<br>CAGCAGGGAGACGAGCTTCATCACGAACGGGAGCTGCCTGGCGAGCAGGAAGACGA<br>GCTTCATGATGGCGCTGTGCCTGAGCAGCATCTACGAGGACCTGAAGATGTACCAG<br>GTGGAGTTCAAGACGATGAACGCGAAGCTGCTGATGGACCCGAAGAGGCAGATCTT<br>CCTGGACCAGAACATGCTGGCGGTGATCGACGAGCTGATGCAGGCGCTGAACTTCA<br>ACAGCGAGACCGTGCCGCAGAAGAGCAGCCTGGAGGAGCCGGACTTCTACAAGACG<br>AAGATCAAGCTGTGCATCCTGCTGCACGCGTTCAGGATCAGGGCGGTGACGATCGA<br>CAGGGTGATGAGCTACCTGAACGCGAGC |
| 16 | hIL12AB_012 ORF | ATGTGCCATCAGCAGCTGGTGATCAGCTGGTTCAGCCTCGTGTTTCTGGCCAGCCC<br>CCTGGTGGCCATTTGGGAACTCAAGAAGGACGTGTATGTAGTGGAACTCGACTGGT<br>ACCCTGACGCCCCAGGCGAAATGGTGGTCTTAACCTGCGACACCCCTGAGGAGGAC<br>GGAATCACCTGGACCTTGGACCAGAGCTCCGAGGTCCTCGGCAGTGGCAAGACCCT<br>GACCATACAGGTGAAAGAATTTGGAGACGCAGGGCAATACACATGTCACAAGGGCG<br>GGGAGGTTCTTTCTCACTCCCTTCTGCTTCTACATAAAAAGGAAGACGGAATTTGG<br>TCTACCGACATCCTCAAGGACCAAAAGGAGCCTAAGAATAAAACCTTCTTACGCTG<br>TGAAGCTAAAAACTACAGCGGCAGATTCACTTGCTGGTGGCTCACCACCATTTCTA<br>CCGACCTGACCTTCTCGGTGAAGTCTTCAAGGGGCTCTAGTGATCCACAGGGAGTG<br>ACATGCGGGGCCGCCACACTGAGCGCTGAACGGGTGAGGGGCGATAACAAGGAGTA<br>TGAATACTCTGTCGAGTGTCAGGAGGATTCAGCTTGTCCCGCAGCTGAAGAGTCAC<br>TCCCCATAGAGGTTATGGTCGATGCTGTGCATAAACTGAAGTACGAAAACTACACC<br>AGCAGCTTCTTCATTCGGGACATTATAAAACCTGACCCCCCCAAGAACCTGCAACT<br>TAAACCCCTGAAAAACTCTCGGCAGGTCGAAGTTAGCTGGGAGTACCCTGATACTT<br>GGTCCACCCCCCACTCGTACTTCTCACTGACTTTCTGTGTGCAGGTGCAGGGCAAG<br>AGCAAGAGAGAGAAAAAGATCGTGTATTCACAGACAAGACCTCTGCCACCGTGAT<br>CTGCAGAAAAAACGCTTCCATCAGTGTCAGAGCCCAAGACCGGTACTATAGTAGTA<br>GCTGGAGCGAGTGGGCAAGTGTCCCCTGCTCTGGCGGCGGAGGGGCGGCTCTCGA<br>AACCTCCCCGTCGCTACCCCTGATCCAGGAATGTTCCCTTGCCTGCATCACTCACA<br>GAATCTGCTGAGAGCGGTCAGCAACATGCTGCAGAAAGCTAGGCAAACACTGGAGT<br>TTTATCCTTGTACCTCAGAGGAGATCGACCACGAGGATATTACCAAGGACAAGACC<br>AGCACGGTGGAGGCCTGCTTGCCCCTGGAACTGACAAAGAATGAATCCTGCCTTAA<br>TAGCCGTGAGACCTCTTTTATAACAAACGGATCCTGCCTGGCCAGCAGGAAGACCT<br>CCTTCATGATGGCCCTCTGCCTGTCCTCAATCTACGAAGACCTGAAGATGTACCAG<br>GTGGAATTTAAAACTATGAACGCCAAGCTGTTGATGGACCCCAAGCGGCAGATCTT<br>TCTGGATCAAAATATGCTGGCTGTGATCGACGAACTGATGCAGGCCCTCAACTTTA<br>ACAGCGAGACCGTGCCACAAAAGAGCAGTCTTGAGGAGCCCGACTTCTACAAGACC<br>AAGATCAAGCTGTGCATCCTCCTTCATGCCTTCAGGATAAGAGCTGTCACCATCGA<br>CAGAGTCATGAGTTACCTGAATGCATCC |
| 17 | hIL12AB_013 ORF | ATGTGCCACCAGCAGCTGGTCATCTCCTGGTTCAGTCTTGTCTTCCTGGCCTCGCC<br>GCTGGTGGCCATCTGGGAGCTGAAGAAAGATGTTTATGTTGTAGAGCTGGACTGGT<br>ACCCAGATGCTCCTGGAGAAATGGTGGTCCTCACCTGTGACACGCCAGAAGAAGAT<br>GGCATCACCTGGACGCTGGACCAGAGCAGTGAAGTTCTTGGAAGTGGAAAAACGCT<br>GACCATACAAGTAAAAGAATTTGGAGATGCTGGCCAGTACACCTGCCACAAAGGAG<br>GAGAAGTTCTCAGCCACAGTTTATTATTACTTCACAAGAAAGAAGATGGCATCTGG<br>TCCACGGACATTTTAAAAGACCAGAAGGAGCCCAAAAATAAAACATTTCTTCGATG<br>TGAGGCCAAGAACTACAGTGGTCGTTTCACCTGCTGGTGGCTGACCACCATCTCCA<br>CAGACCTCACCTTCAGTGTAAAAAGCAGCCGTGGTTCTTCTGACCCCCAAGGAGTC<br>ACCTGTGGGGCTGCCACGCTCTCTGCAGAAAGAGTTCGAGGGGACAACAAAGAATA<br>TGAGTACTCGGTGGAATGTCAAGAAGACTCGGCCTGCCCAGCTGCTGAGGAGAGTC<br>TTCCCATAGAAGTCATGGTGGATGCTGTTCACAAATTAAAATATGAAAACTACACC<br>AGCAGCTTCTTCATCAGAGACATCATCAAACCTGACCCGCCCAAGAACTTACAGCT<br>GAAGCCGCTGAAAAACAGCAGACAAGTAGAAGTTTCCTGGGAGTACCCGGACACCT<br>GGTCCACGCCGCACTCCTACTTCTCCCTCACCTTCTGTGTACAAGTACAAGGCAAG<br>AGCAAGAGAGAGAAGAAAGATCGTGTCTTCACGGACAAAACATCAGCCACGGTCAT<br>CTGCAGGAAAAATGCCAGCATCTCGGTGCGGGCCCAGGACCGCTACTACAGCAGCA<br>GCTGGAGTGAGTGGGCATCTGTGCCCTGCAGTGGTGGTGGGGTGGTGGCAGCAGA<br>AACCTTCCTGTGGCCACTCCAGACCCTGGCATGTTCCCGTGCCTTCACCACTCCCA<br>AAATTTACTTGAGCTGTTTCTAACATGCTGCAGAAAGCAAGACAAACTTTAGAAT<br>CTACCCGTGCACTTCTGAAGAAATTGACCATGAAGACATCACAAAAGATAAAACC<br>AGCACAGTGGAGGCCTGTCTTCCTTTAGAGCTGACCAAAAATGAATCCTGCCTCAA |

SUMMARY OF SEQUENCES

| SEQ ID NO | Description | Sequence |
|---|---|---|
| | | CAGCAGAGAGACCAGCTTCATCACCAATGGCAGCTGCCTGGCCTCCAGGAAAACCA<br>GCTTCATGATGGCGCTCTGCCTCAGCTCCATCTATGAAGATTTGAAGATGTACCAA<br>GTAGAATTTAAAACCATGAATGCCAAATTATTAATGGACCCCAAGAGGCAGATATT<br>TTTAGATCAAAACATGCTGGCAGTTATTGATGAGCTCATGCAAGCATTAAACTTCA<br>ACAGTGAGACTGTACCTCAAAAAAGCAGCCTTGAAGAGCCGGACTTCTACAAAACC<br>AAGATCAAACTCTGCATTTTACTTCATGCCTTCCGCATCCGGGCGGTCACCATTGA<br>CCGTGTCATGTCCTACTTAAATGCCTCG |
| 18 | hIL12AB_014 ORF | ATGTGCCACCAGCAGCTTGTGATTTCTTGGTTCTCTCTTGTGTTCCTTGCTTCTCC<br>TCTTGTGGCTATTTGGGAGTTAAAAAAGGACGTGTACGTGGTGGAGCTTGACTGGT<br>ACCCTGATGCTCCTGGCGAGATGGTGGTGCTTACTTGTGACACTCCTGAGGAGGAC<br>GGCATTACTTGGACTCTTGACCAGTCTTCTGAGGTGCTTGGCTCTGGCAAGACTCT<br>TACTATTCAGGTGAAGGAGTTCGGGGATGCTGGCCAGTACACTTGCCACAAGGGCG<br>GCGAGGTGCTTTCTCACTCTCTTCTTCTTCACAAGAAGGAGGACGGCATTTGG<br>TCTACTGACATTTTAAAAGACCAGAAGGAGCCCAAGAACAAGACTTTCCTTCGTTG<br>CGAGGCCAAGAACTACTCTGGCCGTTTCACTTGCTGGTGGCTTACTACTATTTCTA<br>CTGACCTTACTTTCTCTGTGAAGTCTTCTCGTGGCTCTTCTGACCCTCAGGGCGTG<br>ACTTGTGGGGCTGCTACTCTTTCTGCTGAGCGTGTGCGTGGGGACAACAAGGAGTA<br>CGAGTACTCTGTGGAGTGCCAGGAGGACTCTGCTTGCCCTGCTGCTGAGGAGTCTC<br>TTCCTATTGAGGTGATGGTGGATGCTGTGCACAAGTTAAAATACGAGAACTACACT<br>TCTTCTTTCTTCATTCGTGACATTATTAAGCCTGACCCTCCCAAGAACCTTCAGTT<br>AAAACCTTTAAAAAACTCTCGTCAGGTGGAGGTGTCTTGGGAGTACCCTGACACTT<br>GGTCTACTCCTCACTCTTACTTCTCTCTTACTTTCTGCGTGCAGGTGCAGGGCAAG<br>TCTAAGCGTGAGAAGAAGGACCGTGTGTTCACTGACAAGACTTCTGCTACTGTGAT<br>TTGCAGGAAGAATGCATCTATTTCTGTGCGTGCTCAGGACCGTTACTACTCTTCTT<br>CTTGGTCTGAGTGGGCTTCTGTGCCTTGCTCTGGCGGCGGCGGCGGCTCTAGA<br>AATCTTCCTGTGGCTACTCCTGACCCTGGCATGTTCCCTTGCCTTCACCACTCTCA<br>GAACCTTCTTCGTGCTGTGAGCAACATGCTTCAGAAGGCTCGTCAGACTCTTGAGT<br>TCTACCCTTGCACTTCTGAGGAGATTGACCACGAGGACATCACCAAGGACAAGACT<br>TCTACTGTGGAGGCTTGCCTTCCTCTTGAGCTTACCAAGAATGAATCTTGCTTAAA<br>TTCTCGTGAGACTTCTTTCATCACCAACGGCTCTTGCCTTGCCTCGCGCAAGACTT<br>CTTTCATGATGGCTCTTTGCCTTTCTTCTATTTACGAGGACTTAAAAATGTACCAG<br>GTGGAGTTCAAGACTATGAATGCAAAGCTTCTTATGGACCCCAAGCGTCAGATTTT<br>CCTTGACCAGAACATGCTTGCTGTGATTGACGAGCTTATGCAGGCTTTAAATTTCA<br>ACTCTGAGACTGTGCCTCAGAAGTCTTCTCTTGAGGAGCCTGACTTCTACAAGACC<br>AAGATTAAGCTTTGCATTCTTCTTCATGCTTTCCGTATTCGTGCTGTGACTATTGA<br>CCGTGTGATGTCTTACTTAAATGCTTCT |
| 19 | hIL12AB_015 ORF | ATGTGTCACCAGCAGCTGGTGATCAGCTGGTTTAGCCTGGTGTTTCTGGCCAGCCC<br>CCTGGTGGCCATATGGGAACTGAAGAAAGATGTGTATGTGGTAGAACTGGATTGGT<br>ATCCGGATGCCCCCGGCGAAATGGTGGTGCTGACCTGTGACACCCCCGAAGAAGAT<br>GGTATCACCTGGACCCTGGACCAGAGCAGCGAGGTGCTGGGCAGCGGCAAAACCCT<br>GACCATCCAAGTGAAAGAGTTTGGCGATGCCGGCCAGTACACCTGTCACAAAGGCG<br>GCGAGGTGCTAAGCCATTCGCTGCTGCTGCTGCACAAAAAGGAAGATGGCATCTGG<br>AGCACCGATATCCTGAAGGACCAGAAAGAACCCAAAAATAAGACCTTTCTAAGATG<br>CGAGGCCAAGAATTATAGCGGCCGTTTCACCTGCTGGTGGCTGACGACCATCAGCA<br>CCGATCTGACCTTCAGCGTGAAAAGCAGCAGAGGCAGCAGCGACCCCCAAGGCGTG<br>ACGTGCGGCGCCGCCACCCTGAGCGCCGAGAGAGTGAGAGGCGACAACAAGGAGTA<br>TGAGTACAGCGTGGAGTGCCAGGAGGACAGCGCCTGCCCCGCCGCCGAGGAGAGCC<br>TGCCCATCGAGGTGATGGTGGATGCCGTGCACAAGCTGAAGTATGAAAACTACACC<br>AGCAGCTTCTTCATCAGAGACATCATCAAACCCGACCCCCCCAAGAACCTGCAGCT<br>GAAGCCCCTGAAGAATAGCAGACAGGTGGAGGTGAGCTGGGAGTACCCCGACACCT<br>GGAGCACCCCCCATAGCTACTTCAGCCTGACCTTCTGCGTGCAGGTGCAGGGCAAG<br>AGCAAGAGAGAAAAGAAAGATAGAGTGTTCACGGACAAGACCAGCGCCACGGTGAT<br>CTGCAGAAAAATGCCAGCATCAGCGTGAGAGCCCAGGACAGATACTATAGCAGCA<br>GCTGGAGCGAATGGGCCAGCGTGCCCTGCAGCGGCGGCGGCGGCGGCAGCAGA<br>AACCTGCCCGTGGCCACCCCCGACCCCGGCATGTTCCCCTGCCTGCACCACAGCCA<br>AAACCTGCTGAGAGCCGTGAGCAACATGCTGCAGAAGGCCAGACAAACCCTGGAAT<br>TTTACCCCTGCACCAGCGAAGAGATCGATCATGAAGATATCACCAAAGATAAAACC<br>AGCACCGTGGAGGCCTGTCTGCCCCTGGAACTGACCAAGAATGAGAGCTGCCTAAA<br>TAGCAGAGAGACCAGCTTCATAACCAATGGCAGCTGCCTGGCCAGCAGAAAGACCA<br>GCTTTATGATGGCCCTGTGCCTGAGCAGCATCTATGAAGACCTGAAGATGTACCAG<br>GTGGAGTTCAAGACCATGAATGCCAAGCTGCTGATGGATCCCAAGAGACAGATCTT<br>TCTGGATCAAAACATGCTGGCCGTGATCGATGAGCTGATGCAGGCCCTGAATTTCA<br>ACAGCGAGACCGTGCCCCAAAAAGCAGCCTGGAAGAACCGGATTTTTATAAAACC<br>AAAATCAAGCTGTGCATACTGCTGCATGCCTTCAGAATCAGAGCCGTGACCATCGA<br>TAGAGTGATGAGCTATCTGAATGCCAGC |
| 20 | hIL12AB_016 ORF | ATGTGCCACCAGCAGCTGGTCATCAGCTGGTTCAGCCTGGTCTTCCTGGCCAGCCC<br>CCTGGTGGCCATCTGGGAGCTGAAGAAGGATGTTTATGTTGTGGAGCTGGACTGGT<br>ACCCAGATGCCCCTGGGGAGATGGTGGTGCTGACCTGTGACACCCCAGAAGAGGAT<br>GGCATCACCTGGACCCTGGACCAGAGCTCAGAAGTGCTGGGCAGTGGAAAAACCCT<br>GACCATCCAGGTGAAGGAGTTTGGAGATGCTGGCCAGTACACCTGCCACAAGGGTG |

| SEQ ID NO | Description | Sequence |
|---|---|---|
| | | GTGAAGTGCTGAGCCACAGCCTGCTGCTGCTGCACAAGAAGGAGGATGGCATCTGG<br>AGCACAGACATCCTGAAGGACCAGAAGGAGCCCAAGAACAAGACCTTCCTTCGCTG<br>TGAAGCCAAGAACTACAGTGGCCGCTTCACCTGCTGGTGGCTGACCACCATCAGCA<br>CAGACCTCACCTTCTCGGTGAAGAGCAGCAGAGGCAGCTCAGACCCCCAGGGTGTC<br>ACCTGTGGGGCGGCCACGCTGTCGGCGGAGAGAGTTCGAGGGGACAACAAGGAGTA<br>TGAATACTCGGTGGAGTGCCAGGAGGACTCGGCGTGCCCGGCGGCAGAAGAGAGCC<br>TGCCCATAGAAGTGATGGTGGATGCTGTGCACAAGCTGAAGTATGAAAACTACACC<br>AGCAGCTTCTTCATCAGAGACATCATCAAGCCAGACCCGCCCAAGAACCTGCAGCT<br>GAAGCCCCTGAAGAACAGCAGACAAGTGGAGGTTTCCTGGGAGTACCCAGACACGT<br>GGAGCACCCCCACAGCTACTTCAGCCTGACCTTCTGTGTCCAGGTGCAGGGCAAG<br>AGCAAGAGAGAGAAGAAGGACAGAGTCTTCACAGACAAGACCTCGGCCACGGTCAT<br>CTGCAGAAAGAATGCCTCCATCTCGGTTCGAGCCCAGGACAGATACTACAGCAGCA<br>GCTGGTCAGAATGGGCCTCGGTGCCCTGCAGTGGTGGCGGCGGCGGCGGCAGCAGA<br>AACCTGCCTGTTGCCACCCCAGACCCTGGGATGTTCCCCTGCCTGCACCACAGCCA<br>GAACTTATTACGAGCTGTTTCTAACATGCTGCAGAAGGCCAGACAAACCCTGGAGT<br>TCTACCCCTGCACCTCAGAAGAGATTGACCATGAAGACATCACCAAGGACAAGACC<br>AGCACTGTAGAGGCCTGCCTGCCCCTGGAGCTGACCAAGAATGAAAGCTGCCTGAA<br>CAGCAGAGAGACCAGCTTCATCACCAATGGAAGCTGCCTGGCCAGCAGAAAGACCA<br>GCTTCATGATGGCCCTGTGCCTGAGCAGCATCTATGAAGACCTGAAGATGTACCAG<br>GTGGAGTTCAAGACCATGAATGCAAAGCTGCTGATGGACCCCAAGAGACAAATATT<br>TTTGGACCAGAACATGCTGGCTGTCATTGATGAGCTGATGCAGGCCCTGAACTTCA<br>ACTCAGAAACTGTACCCCAGAAGAGCAGCCTGGAGGAGCCAGACTTCTACAAGACC<br>AAGATCAAGCTGTGCATCCTGCTTCATGCTTTCAGAATCAGAGCTGTCACCATTGA<br>CCGCGTGATGAGCTACTTAAATGCCTCG |
| 21 | hIL12AB_017 ORF | ATGTGCCACCAGCAGCTGGTAATCAGCTGGTTTTCCCTCGTCTTTCTGGCATCACC<br>CCTGGTGGCTATCTGGGAGCTGAAGAAGGACGTGTACGTGGTGGAGCTGGATTGGT<br>ACCCTGACGCCCCGGGGAAATGGTGGTGTTAACATGCGACACGCTGAGGAGGAC<br>GGCATCACCTGGACACTGGACCAGAGCAGCGAGGTGCTTGGGTCTGGTAAAACTCT<br>GACTATTCAGGTGAAAGAGTTCGGGGATGCCGGCCAATATACTTGCCACAAGGGTG<br>GCGAGGTGCTTTCTCATTCTCTGCTCCTGCTGCACAAGAAAGAAGATGGCATTTGG<br>TCTACTGATATTCTGAAAGACCAGAAGGAGCCCAAGAACAAGACCTTTCTGAGATG<br>CGAGGCTAAAAACTACAGCGGAAGATTTACCTGCTGGTGGCTGACCACAATCTCAA<br>CCGACCTGACATTTTCAGTGAAGTCCAGCAGAGGGAGCTCCGACCCTCAGGGCGTG<br>ACCTGCGGAGCCGCCACTCTGTCCGCAGAAAGAGTGAGAGGTGATAATAAGGAGTA<br>CGAGTATTCAGTCGAGTGCCAAGAGGACTCTGCCTGCCCAGCCGCCGAGGAGAGCC<br>TGCCAATCGAGGTGATGGTAGATGCGGTACACAAGCTGAAGTATGAGAACTACACA<br>TCCTCCTTCTTCATAAGAGACATTATCAAGCCTGACCCACCTAAAAATCTGCAACT<br>CAAGCCTTTGAAAAATTCAAGACAGGTGGAGGTGAGCTGGGAGTACCCTGATACTT<br>GGAGCACCCCCCATAGCTACTTTTCGCTGACATTCTGCGTCCAGGTGCAGGGCAAG<br>TCAAAGAGAGAGAAGAAGGATCGCGTGTTCACTGATAAGACAAGCGCCACAGTGAT<br>CTGCAGAAAAAACGCTAGCATTAGCGTCAGAGCACAGGACCGGTATTACTCCAGCT<br>CCTGGAGCGAATGGGCATCTGTGCCCTGCAGCGGTGGGGCGGAGGCGGATCTAGA<br>AACCTCCCCGTTGCCACACCTGATCCTGGAATGTTCCCCTGTCTGCACCACAGCCA<br>GAACCTGCTGAGAGCAGTGTCTAACATGCTCCAGAAGGCCAGGCAGACCCTGGAGT<br>TTTACCCCTGCACCAGCGAGGAAATCGATCACGAGGACATCACCAAAGATAAAACC<br>TCCACCGTGGAGGCCTGCCTGCCCCTGGAACTGACCAAAAACGAGAGCTGCCTGAA<br>TAGCAGGGAGACCTCCTTCATCACCAACGGCTCATGCCTTGCCAGCCGGAAAACTA<br>GCTTCATGATGGCCCTGTGCCTGTCTTCGATCTATGAGGACCTGAAAATGTACCAG<br>GTCGAATTTAAGACGATGAACGCAAAGCTGCTGATGGACCCCAAGCGGCAGATCTT<br>TCTGGACCAGAACATGCTGGCAGTCATAGATGAGTTGATGCAGGCATTAAACTTCA<br>ACAGCGAGACCGTGCCTCAGAAGTCCAGCCTCGAGGAGCCAGATTTTTATAAGACC<br>AAGATCAAACTATGCATCCTGCTGCATGCTTTCAGGATTAGAGCCGTCACCATCGA<br>TCGAGTCATGTCTTACCTGAATGCTAGC |
| 22 | hIL12AB_018 ORF | ATGTGTCACCAACAGTTAGTAATCTCCTGGTTTTCTCTGGTGTTTCTGGCCAGCCC<br>CCTCGTGGCCATCTGGGAGCTTAAAAAGGATGTGTACGTGGTGGAGCTGGACTGGT<br>ATCCCGATGCACCAGGCGAAATGGTCGTGCTGACCTGCGATACCCCTGAAGAAGAT<br>GGCATCACCTGGACTCTGGACCAGTCTTCCGAGGTGCTTGGATCTGGCAAGACTCT<br>GACAATACAAGTTAAGGAGTTCGGGGACGCAGGACAGTACACCTGCCACAAAGGCG<br>GCGAGGTCCTGAGTCACTCCCTGTTACTGCTCCACAAGAAAGAGGACGGCATTTGG<br>TCCACCGACATTCTGAAGGACCAGAAGGAGCCTAAGAATAAAACTTTCCTGAGATG<br>CGAGGCAAAAACTATAGCGGCCGCTTTACTTGCTGGTGGCTTACAACAATCTCTA<br>CCGATTTAACTTTCTCCGTGAAGTCTAGCAGAGGATCCTCTGACCCGCAAGGAGTG<br>ACTTGCGGAGCCGCCACCTTGAGCGCCGAAAGAGTCCGTGGCGATAACAAAGAATA<br>CGAGTACTCCGTGGAGTGCCAGGAAGATTCCGCCTGCCCAGCTGCCGAGGAGTCCC<br>TGCCCATTGAAGTGATGGTGGATGCCGTCCACAAGCTGAAGTACGAAAACTATACC<br>AGCAGCTTCTTCATCCGGGATATCATTAAGCCCGACCCTCCTAAAAACCTGCAACT<br>TAAGCCCCTAAAGAATAGTCGGCAGGTTGAGGTCAGCTGGGAATATCCTGACACAT<br>GGAGCACCCCCACTCTTATTTCTCCCTGACCTTCTGCGTGCAGGTGCAGGGCAAG<br>AGTAAACGGGAGAAAAAGGACAGGGTCTTTACCGATAAAACCAGCGCTACGGTTAT<br>CTGTCGGAAGAACGCTTCCATCTCCGTCCGCGCTCAGGATCGTTACTACTCGTCCT<br>CATGGAGCGAGTGGGCCAGCGTGCCCTGCAGCGGCGGCGGTGGAGGCGGATCCAGA |

| SEQ ID NO | Description | Sequence |
|---|---|---|
|  |  | AATCTGCCTGTTGCCACACCAGACCCTGGCATGTTCCCCTGTCTGCATCATAGCCA<br>GAACCTGCTCAGAGCCGTGAGCAACATGCTCCAGAAGGCCAGGCAGACATTGGAGT<br>TCTACCCGTGTACATCTGAGGAAATCGATCACGAAGATATAACCAAGGACAAAACC<br>TCTACAGTAGAGGCTTGTTTGCCCCTGGAGTTGACCAAAAACGAGAGTTGCCTGAA<br>CAGTCGCGAGACAAGCTTCATTACTAACGGCAGCTGTCTCGCCTCCAGAAAGACAT<br>CCTTCATGATGGCCCTGTGTCTTTCCAGCATATACGAAGACCTGAAAATGTACCAG<br>GTCGAGTTCAAAACAATGAACGCCAAGCTGCTTATGGACCCCAAGAGACAGATCTT<br>CCTCGACCAAAACATGCTCGCTGTGATCGATGAGCTGATGCAGGCTCTCAACTTCA<br>ATTCCGAAACAGTGCCACAGAAGTCCAGTCTGGAAGAACCCGACTTCTACAAGACC<br>AAGATTAAGCTGTGTATTTTGCTGCATGCGTTTAGAATCAGAGCCGTGACCATTGA<br>TCGGGTGATGAGCTACCTGAACGCCTCG |
| 23 | hIL12AB_019 ORF | ATGTGCCACCAGCAGCTTGTCATCTCCTGGTTTTCTCTTGTCTTCCTGGCCTCGCC<br>GCTGGTGGCCATCTGGGAGCTGAAGAAAGATGTCTATGTTGTAGAGCTGGACTGGT<br>ACCCAGATGCTCCTGGAGAAATGGTGGTTCTCACCTGTGACACTCCTGAAGAAGAT<br>GGCATCACCTGGACGCTGGACCAAAGCTCAGAAGTTCTTGGCAGTGGAAAAACGCT<br>GACCATACAAGTAAAAGAATTTGGGGATGCTGGCCAGTACACGTGCCACAAAGGAG<br>GAGAAGTTCTCAGCCACAGTTTACTTCTTCTTCACAAGAAGAAGATGGCATCTGG<br>TCCACGGACATTTTAAAAGACCAGAAGGAGCCCAAGAACAAAACCTTCCTCCGCTG<br>TGAGGCCAAGAACTACAGTGGTCGTTTCACCTGCTGGTGGCTCACCACCATCTCCA<br>CTGACCTCACCTTCTCTGTAAAAAGCAGCCGTGGTTCTTCTGACCCCCAAGGAGTC<br>ACCTGTGGGGCTGCCACGCTCTCGGCAGAAAGAGTTCGAGGGGACAACAAGGAATA<br>TGAATATTCTGTGGAATGTCAAGAAGATTCTGCCTGCCCGGCGGCAGAAGAAAGTC<br>TTCCCATAGAAGTCATGGTGGATGCTGTTCACAAATTAAAATATGAAAACTACACC<br>AGCAGCTTCTTCATTCGTGACATCATCAAACCAGACCCGCCCAAGAACCTTCAGTT<br>AAAACCTTTAAAAAACAGCAGACAAGTAGAAGTTTCCTGGGAGTACCCGGACACGT<br>GGTCCACGCCGCACTCCTACTTCAGTTTAACCTTCTGTGTACAAGTACAAGGAAAA<br>TCAAAAAGAGAGAAGAAAGATCGTGTCTTCACTGACAAAACATCTGCCACGGTCAT<br>CTGCAGGAAGAATGCCTCCATCTCGGTTCGAGCCCAGGACCGCTACTACAGCAGCA<br>GCTGGAGTGAGTGGGCATCTGTTCCCTGCAGTGGTGGCGGCGGCGGCGGCAGCCGC<br>AACCTTCCTGTGGCCACGCCGGACCCTGGCATGTTCCCGTGCCTTCACCACTCCCA<br>AAATCTTCTTCGTGCTGTTTCTAACATGCTGCAGAAGGCGCGCCAAACTTTAGAAT<br>TCTACCCGTGCACTTCTGAAGAAATAGACCATGAAGACATCACCAAAGATAAAACC<br>AGCACGGTGGAGGCCTGCCTTCCTTTAGAGCTGACCAAGAATGAATCCTGCCTCAA<br>CAGCAGAGAGACCAGCTTCATCACCAATGGCAGCTGCCTGGCCTCGCGCAAGACCA<br>GCTTCATGATGGCGCTGTGCCTTTCTTCCATCTATGAAGATTTAAAGATGTACCAA<br>GTAGAATTTAAAACCATGAATGCCAAATTATTAATGGACCCCAAAAGACAAATATT<br>TTTGGATCAAAACATGCTGGCTGTCATTGATGAGCTCATGCAAGCATTAAACTTCA<br>ACTCAGAAACTGTTCCCCAGAAGTCATCTTTAGAAGAGCCGGACTTCTACAAAACA<br>AAAATAAAACTCTGCATTCTTCTTCATGCCTTCCGCATCCGTGCTGTCACCATTGA<br>CCGTGTCATGTCCTACTTAAATGCTTCT |
| 24 | hIL12AB_020 ORF | ATGTGCCACCAGCAGCTGGTGATCAGCTGGTTCAGCCTGGTGTTCCTGGCTAGCCC<br>TCTGGTGGCCATCTGGGAGCTGAAGAAGGACGTGTACGTGGTGGAGTTAGACTGGT<br>ACCCCGACGCTCCCGGCGAGATGGTGGTGCTGACCTGCGACACCCCCGAGGAGGAC<br>GGGATCACCTGGACCCTGGATCAGTCAAGCGAGGTGCTGGGAAGCGGCAAGACCCT<br>GACCATCCAGGTGAAGGAGTTCGGCGACGCCGGCCAATACACTTGCCACAAGGGAG<br>GCGAGGTGCTGTCCCACTCCCTCCTGCTGCTGCACAAAAAGGAAGACGGCATCTGG<br>AGCACCGACATCCTGAAAGACCAGAAGGAGCCTAAGAACAAGACATTCCTCAGATG<br>CGAGGCCAAGAATTACTCCGGGAGATTCACCTGTTGGTGGCTGACCACCATCAGCA<br>CAGACCTGACCTTCAGCGTGAAGAGCAGCAGAGGCAGCAGCGACCCCCAGGGCGTG<br>ACCTGTGGCGCCGCCACCCTGAGCGCCGAAAGAGTGCGCGGCGACAACAAGGAGTA<br>CGAGTACTCCGTGGAATGCCAGGAGGACAGCGCCTGCCCCGCCGCCGAGGAGAGCC<br>TGCCCATCGAGGTGATGGTGGACGCCGTCCACAAGCTGAAGTACGAGAACTACACC<br>TCTAGCTTCTTCATCCGGGACATCATCAAGCCCGATCCCCCCAAGAACCTGCAGCT<br>GAAACCCCTGAAGAACAGCAGACAGGTGGAGGTGAGCTGGGAGTATCCCGACACCT<br>GGTCCACCCCCACAGCTATTTTAGCCTGACCTTCTGCGTGCAAGTGCAGGGCAAG<br>AGCAAGAGAGAAGAAGGACCGCGTGTTCACCGACAAAACCAGCGCCACCGTGATC<br>TGCAGAAAGAACGCCAGCATCAGCGTGAGGGCCCAGGATAGATACTACAGTTCCA<br>GCTGGAGCGAGTGGGCCAGCGTGCCCTGCAGCGGCGGCGGCGGGGAGGCTCTAGA<br>AACCTGCCCGTGGCTACCCCCGATCCCGGAATGTTCCCTGCCTGCACCACAGCCA<br>GAACCTGCTGAGGGCGGTGTCCAACATGCTTCAGAAGGCCCGGCAGACCCTGGAGT<br>TCTACCCCTGTACCTCTGAGGAGATCGATCATGAGGACATCACAAAGGACAAAACC<br>AGCACCGTGGAGGCCTGCCTGCCCCTGGAGCTGACCAAGAACGAGAGCTGCCTGAA<br>CTCCCGCGAGACCAGCTTCATCACGAACGGCAGCTGCCTGGCCAGCAGGAAGACCT<br>CCTTCATGATGGCCCTGTGCCTGAGCAGCATCTACGAGGACCTGAAAATGTACCAG<br>GTGGAGTTTAAGACCATGAACGCCAAGCTGCTGATGGACCCCAAGCGGCAAATCTT<br>CCTGGACCAGAACATGCTGGCAGTGATCGACGAGCTCATGCAGGCCCTGAACTTCA<br>ATAGCGAGACAGTCCCCCAGAAGAGCAGCCTGGAGGAGCCCGACTTTTACAAGACC<br>AAGATCAAGCTGTGCATCCTGCTGCACGCCTTTAGAATCCGTGCCGTGACCATTGA<br>CAGAGTGATGAGCTACCTGAATGCCAGC |

-continued

SUMMARY OF SEQUENCES

| SEQ ID NO | Description | Sequence |
|---|---|---|
| 25 | hIL12AB_021 ORF | ATGTGCCACCAGCAGCTGGTGATCAGCTGGTTCAGCCTGGTGTTCCTGGCCAGCCC<br>TCTGGTTGCCATCTGGGAGCTGAAGAAAGACGTGTACGTCGTGGAACTGGACTGGT<br>ATCCGGACGCCCCGGGCGAGATGGTGGTGCTGACCTGTGACACCCCCGAGGAGGAC<br>GGCATCACCTGGACGCTGGACCAATCCTCCGAGGTGCTGGGAAGCGGCAAGACCCT<br>GACCATCCAGGTGAAGGAATTCGGGGACGCCGGGCAGTACACCTGCCACAAGGGGG<br>GCGAAGTGCTGTCCCACTCGCTGCTGCTCCTGCATAAGAAGGAGGATGGAATCTGG<br>TCCACCGACATCCTCAAAGATCAGAAGGAGCCCAAGAACAAGACGTTCCTGCGCTG<br>TGAAGCCAAGAATTATTCGGGGCGATTCACGTGCTGGTGGCTGACAACCATCAGCA<br>CCGACCTGACGTTTAGCGTGAAGAGCAGCAGGGGGTCCAGCGACCCCCAGGGCGTG<br>ACGTGCGGCGCCGCCACCCTCTCCGCCGAGAGGGTGCGGGGGGACAATAAGGAGTA<br>CGAGTACAGCGTGGAATGCCAGGAGGACAGCGCCTGCCCCGCCGCGGAGGAAAGCC<br>TCCCGATAGAGGTGATGGTGGACGCCGTGCACAAGCTCAAGTATGAGAATTACACC<br>AGCAGCTTTTTCATCCGGGACATTATCAAGCCCGACCCCCCGAAGAACCTCCAGCT<br>GAAGCCCCTGAAGAACAGCCGGCAGGTGGAAGTCTCCTGGGAGTATCCCGACACCT<br>GGAGCACCCCGCACAGCTACTTCTCCCTGACCTTCTGTGTGCAGGTGCAGGGCAAG<br>TCCAAGAGGGAAAAGAAGGACAGGGTTTTCACCGACAAGACCAGCGCGACCGTGAT<br>CTGCCGGAAGAACGCCAGCATAAGCGTCCGCGCCCAAGATAGGTACTACAGCAGCT<br>CCTGGAGCGAGTGGGCTAGCGTGCCCTGCAGCGGGGCGGGGTGGGGCTCCAGG<br>AACCTGCCAGTGGCGACCCCCGACCCCGGCATGTTCCCCTGCCTCCATCACAGCCA<br>GAACCTGCTGAGGGCCGTCAGCAATATGCTGCAGAAGGCCAGGCAGACCCTGGAAT<br>TCTACCCCTGCACGTCGGAGGAGATCGATCACGAGGATATCACAAAAGACAAGACT<br>TCCACCGTGGAGGCCTGCCTGCCCCTGGAGCTCACCAAGAATGAGTCCTGTCTGAA<br>CTCCCGGGAAACCAGCTTCATCACCAACGGGTCCTGCCTGGCCAGCAGGAAGACCA<br>GCTTTATGATGGCCCTGTGCCTGTCGAGCATCTACGAGGACCTGAAGATGTACCAG<br>GTCGAGTTCAAGACAATGAACGCCAAGCTGCTGATGGACCCCAAGAGGCAAATCTT<br>CCTGGACCAGAATATGCTTGCCGTCATCGACGAGCTCATGCAGGCCCTGACTTCA<br>ACTCCGAGACCGTGCCCCAGAAGAGCAGCCTGGAGGAGCCCGACTTCTACAAGACC<br>AAGATCAAGCTGTGCATCCTGCTGCACGCGTTCAGGATCCGGGCAGTCACCATCGA<br>CCGTGTGATGTCCTACCTGAACGCCAGC |
| 26 | hIL12AB_022 ORF | ATGTGCCATCAGCAGCTGGTGATCAGCTGGTTCAGCCTGGTGTTCCTCGCCTCTCC<br>CCTGGTGGCCATCTGGGAGCTCAAAAAGGACGTGTACGTGGTGGAGCTCGACTGGT<br>ACCCAGACGCCCCCGGGGAGATGGTGGTGCTGACCTGCGACACCCCCGAAGAAGAC<br>GGCATCACGTGGACCCTCGACCAGTCCAGCGAGGTGCTGGGGAGCGGGAAGACTCT<br>GACCATCCAGGTCAAGGAGTTCGGGGACGCCGGGCAGTACACGTGCCACAAGGGCG<br>GCGAAGTCTTAAGCCACAGCTGCTCCTGCTGCACAAGAAGGAGGACGGGATCTGG<br>TCCACAGACATACTGAAGGACCAGAAGGAGCCGAAGAATAAAACCTTTCTGAGGTG<br>CGAGGCCAAGAACTATTCCGGCAGGTTCACGTGCTGGTGGCTTACAACAATCAGCA<br>CAGACCTGACGTTCAGCGTGAAGTCCAGCCGCGGCAGCAGCGACCCCCAGGGGGTG<br>ACCTGCGGCGCCGCCACCCTGAGCGCCGAGCGGGTGCGCGGGGACAACAAGGAGTA<br>CGAGTACTCCGTGGAGTGCCAGGAAGACAGCGCCTGTCCCGCCGCCGAAGAGAGCC<br>TGCCTATCGAGGTCATGGTAGATGCAGTGCATAAGCTGAAGTACGAGAACTATACG<br>AGCAGCTTTTTCATACGCGACATCATCAAGCCCGACCCCCCCAAGAACCTGCAGCT<br>TAAGCCCCTGAAGAATAGCCGGCAGGTGGAGGTCTCCTGGGAGTACCCCGACACCT<br>GGTCAACGCCCCACAGCTACTTCTCCCTGACCTTTTGTGTCCAAGTCCAGGGAAAG<br>AGCAAGAGGGAGAAGAAAGATCGGGTGTTCACCGACAAGACCTCCGCCACGGTGAT<br>CTGCAGGAAGAACGCCAGCATCTCCGTGAGGGCGCAAGACAGGTACTACTCCAGCA<br>GCTGGTCCGAATGGGCCAGCGTGCCCTGCTCCGGCGGCGGGGCGGCGGCAGCCGA<br>AACCTACCCGTGGCCACGCCGGATCCCGGCATGTTTCCCTGCCTGCCACCACAGCCA<br>GAACCTCCTGAGGGCCGTGTCCAACATGCTGCAGAAGGCCAGGCAGACTCTGGAGT<br>TCTACCCCTGCACGAGCGAGGAGATCGATCACGAGGACATCACCAAGGATAAGACC<br>AGCACTGTGGAGGCCTGCCTTCCCCTGGAGCTGACCAAGAACGAGAGCTGTCTGAA<br>CTCCAGGGAGACCTCATTCATCACCAACGGCTCCTGCCTGGCCAGCAGGAAAACCA<br>GCTTCATGATGGCCTTGTGTCTCAGCTCCATCTACGAGGACCTGAAGATGTATCAG<br>GTCGAGTTCAAGACAATGAACGCCAAGCTGCTGATGGACCCCAAAAGGCAGATCTT<br>CCTGGACCAGAACATGCTGGCCGTCATCGACGAGCTGATGCAGGCCCTGAACTTCA<br>ACAGCGAGACGGTGCCCCAGAAAAGCTCCCTGGAGGAGCCCGACTTCTACAAGACC<br>AAGATCAAGCTGTGCATCCTGCTGCACGCCTTCAGGATCAGGGCAGTGACCATCGA<br>CCGGGTGATGTCATACCTTAACGCCAGC |
| 27 | hIL12AB_023 ORF | ATGTGCCATCAGCAGCTGGTGATCTCCTGGTTCAGCCTGGTGTTTCTGGCCTCGCC<br>CCTGGTCGCCATCTGGGAGCTGAAGAAAGACGTGTACGTCGTCGAACTGGACTGGT<br>ACCCCGACGCCCCCGGGGAGATGGTGGTGCTGACCTGCGACACGCCGAGGAGGAC<br>GGCATCACCTGGACCCTGGATCAAAGCAGCGAGGTGCTGGGCAGCGGCAAGACCCT<br>GACCATCCAAGTGAAGGAATTCGGCGATGCCGGCCAGTACACCTGTCACAAAGGGG<br>GCGAGGTGCTCAGCCACAGCTGCTGCTGCTGCACAAGAAGGAGGATGGCATCTGG<br>AGCACCGATATCCTGAAGGACCAGAAAGAGCCCAAGAACAAGACGTTCCTGAGGTG<br>CGAGGCCAAGAACTACAGCGGGTAGGTTCACGTGTTGGTGGCTGACCACCATCAGCA<br>CCGACCTGACGTTCAGCGTGAAGAGCTCCAGGGGCAGCTCCGACCCACAGGGGGTG<br>ACGTGCGGGGCCGCCAACCCTCAGCGCCGAAAGGGTGCGGGGGGACAACAAGGAGTA<br>CGAATACTCCGTGGAGTGCCAGGAAGATTCGGCCTGCCCCGCCGCGGAGGAGAGCC<br>TCCCCATCGAGGTAATGGTGGACGCCGTGCATAAGCTGAAGTACGAGAACTACACC<br>AGCTCGTTCTTCATCCGAGACATCATCAAACCCGACCCGCCCAAAAATCTGCAGCT |

SUMMARY OF SEQUENCES

| SEQ ID NO | Description | Sequence |
|---|---|---|
| | | CAAGCCCCTGAAGAACTCCAGGCAGGTGGAGGTGAGCTGGGAGTACCCCGACACCT<br>GGTCCACCCCGCACAGCTACTTCTCCCTGACATTCTGCGTGCAGGTGCAGGGCAAG<br>AGCAAGCGGGAGAAGAAGGACAGGGTGTTCACCGACAAGACGAGCGCCACCGTGAT<br>CTGCCGAAAGAACGCCAGCATCTCGGTGCGCGCCCAGGATAGGTACTATTCCAGCT<br>CCTGGAGCGAGTGGGCCTCGGTACCCTGCAGCGGCGGCGGGGGCGGCGGCAGTAGG<br>AATCTGCCCGTGGCTACCCCGGACCCGGGCATGTTCCCCTGCCTCCACCACAGCCA<br>GAACCTGCTGAGGGCCGTGAGCAACATGCTGCAGAAGGCCAGACAGACGCTGGAGT<br>TCTACCCCTGCACGAGCGAGGAGATCGACCACGAGGACATCACCAAGGATAAAACT<br>TCCACCGTCGAGGCCTGCCTGCCCTTGGAGCTGACCAAGAATGAATCCTGTCTGAA<br>CAGCAGGGAGACCTCGTTTATCACCAATGGCAGCTGCCTCGCCTCCAGGAAGACCA<br>GCTTCATGATGGCCCTCTGTCTGAGCTCCATCTATGAGGACCTGAAGATGTACCAG<br>GTGGAGTTCAAGACCATGAACGCGAAGCTGCTGATGGACCCCAAGAGGCAGATCTT<br>CCTGGATCAGAATATGCTGGCGGTGATCGACGAGCTCATGCAGGCCCTCAATTTCA<br>ATAGCGAGACAGTGCCCCAGAAGTCCTCCCTGGAGGAGCCCGACTTCTACAAGACC<br>AAGATCAAGCTGTGTATCCTGCTGCACGCCTTCCGGATCCGGGCCGTCACCATCGA<br>CCGGGTCATGAGCTACCTCAATGCCAGC |
| 28 | hIL12AB_024 ORF | ATGTGCCACCAGCAGCTGGTGATCTCCTGGTTCTCCCTGGTGTTCCTGGCCTCGCC<br>CCTGGTGGCCATCTGGGAGCTGAAGAAGGACGTGTACGTCGTGGAGCTCGACTGGT<br>ACCCCGACGCCCCTGGCGAGATGGTGGTGCTGACCTGCGACACCCCAGAGGAGGAT<br>GGCATCACCTGGACCCTGGATCAGTCCTCCGAGGTGCTGGGCTCCGGCAAGACGCT<br>GACCATCCAAGTGAAGGAGTTCGGTGACGCCGGACAGTATACCTGCCATAAGGGCG<br>GCGAGGTCCTGTCCCACAGCCTCCTCCTCCTGCATAAGAAGGAGGACGGCATCTGG<br>AGCACCGACATCCTGAAGGACCAGAAGGAGCCCAAGAACAAGACCTTTCTGAGGTG<br>CGAGGCCAAGAACTACAGCGGCCGATTCACCTGCTGGTGGCTCACCACCATATCCA<br>CCGACCTGACTTTCTCCGTCAAGTCCTCCCGGGGGTCCAGCGACCCCCAGGGAGTG<br>ACCTGCGGCGCCGCCACCCTCAGCGCCGAGCGGGTGCGGGGGGACAACAAGGAGTA<br>CGAATACTCCGTCGAGTGCCAGGAGGACTCCGCCTGCCCGGCCGCCGAGGAGAGCC<br>TGCCCATCGAGGTGATGGTCGACGCGGTGCACAAGCTGAAGTACGAGAACTACACC<br>AGCAGTTTCTTCATCAGGGATATCATCAAGCCAGATCCCCCGAAGAATCTGCAACT<br>GAAGCCGCTGAAAAACTCACGACAGGTGGAGGTGAGCTGGGAGTACCCCGACACGT<br>GGAGCACCCCACATTCCTACTTCAGCCTGACCTTCTGCGTGCAGGTCCAGGGCAAG<br>AGCAAGCGGGAGAAGAAGGACAGGGTGTTCACGGATAAGACCAGTGCCACCGTGAT<br>CTGCAGGAAGAACGCCTCTATTAGCGTGAGGGCCCAGGATCGGTATTACTCCTCGA<br>GCTGGAGCGAATGGGCCTCCGTGCCCTGCAGTGGGGGGGTGGAGGCGGGAGCAGG<br>AACCTGCCCGTAGCAACCCCCGACCCCGGGATGTTCCCCTGTCTGCACCACTCGCA<br>GAACCTGCTGCGCGCGGTGAGCAACATGCTCCAAAAAGCCCGTCAGACCTTAGAGT<br>TCTACCCCTGCACCAGCGAAGAAATCGACCACGAAGACATCACCAAGGACAAAACC<br>AGCACCGTGGAGGCGTGCCTGCCGCTGGAGCTGACCAAGAACGAGAGCTGCCTCAA<br>CTCCAGGGAGACCAGCTTTATCACCAACGGCTCGTGCCTAGCCAGCCGGAAAACCA<br>GCTTCATGATGGCCCTGTGCCTGAGCTCCATTTACGAGGACCTGAAGATGTATCAG<br>GTGGAGTTCAAGACCATGAATGCCAAACTCCTGATGGACCCCAAGAGGCAGATCTT<br>CCTGGACCAGAACATGCTCGCGGTGATCGATGAGCTGATGCAGGCCCTGAACTTTA<br>ATAGCGAGACCGTGCCCCAGAAAAGCAGCCTGGAGGAGCCGGACTTCTACAAGACC<br>AAAATCAAGCTGTGCATCCTGCTCCACGCCTTCCGCATCCGGGCCGTGACCATCGA<br>CAGGGTGATGAGCTACCTGAACGCCAGC |
| 29 | hIL12AB_025 ORF | ATGTGCCATCAGCAGCTGGTGATTTCCTGGTTCTCCCTGGTGTTCCTGGCCAGCCC<br>CCTCGTGGCGATCTGGGAGCTAAAGAAGGACGTGTACGTGGTGGAGCTGGACTGGT<br>ACCCGGACGCACCCGGCGAGATGGTCGTTCTGACCTGCGATACGCCAGAGGAGGAC<br>GGCATCACCTGGACCCTCGATCAGAGCAGCGAGGTCCTGGGGAGCGGAAAGACCCT<br>GACCATCCAGGTCAAGGAGTTCGGCGACGCCGGCCAGTACACCTGCCACAAAGGTG<br>GCGAGGTCCTGAGCCACTCGCTGCTGCTCCTGCATAAGAAGGAGGACGGAATCTGG<br>AGCACAGACATCCTGAAAGACCAGAAGGAGCCCAAGAACAAGACCTTCCTGAGGTG<br>CGAGGCCAAGAACTACAGCGGGCGCTTCACGTGCTGGTGGCTGACCACCATCAGCA<br>CGGACCTCACCTTCTCCGTGAAGAGCAGCCGGGGATCCAGCGATCCCCAAGGCGTC<br>ACCTGCGGCGCGGCCACCCTGAGCGCGGAGAGGGTCAGGGGCGATAATAAGGAGTA<br>TGAGTACAGCGTGGAGTGCCAGGAGGACAGCGCCTGCCCGGCCGCCGAGGAGTCCC<br>TGCCAATCGAAGTGATGGTCGACGCCGTGCACAAGCTGAAGTACGAGAACTACACC<br>AGCAGCTTCTTCATCCGGGATATCATCAAGCCCGATCCCCCGAAGAACCTGCAGCT<br>GAAGCCCCTCAAGAACAGCCGGCAGGTGGAGGTGAGTTGGGAGTACCCCGACACCT<br>GGTCAACGCCCCACAGCTACTTCTCCCTGACCTTCTGTGTGCAGGTGCAGGGAAAG<br>AGCAAGAGGGAGAAGAAAGACCGGGTCTTCACCGACAAGACCAGCGCCACGGTGAT<br>CTGCAGGAAGAACGCAAGCATCTCCGTGAGGGCCCAGGACAGGTACTACAGCTCCA<br>GCTGGTCCGAATGGGCCAGCGTGCCCTGTAGCGGCGGCGGGGGCGGTGGCAGCCGC<br>AACCTCCCAGTGGCCACCCCCGACCCCGGCATGTTCCCCTGCCTGCACCACAGCCA<br>GAATCTGCTGAGGGCCGTGAGTAACATGCTGCAGAAGGCAAGGCAAACCCTCGAAT<br>TCTATCCCTGCACCTCCGAGGAGATCGACCACGAGGATATCACCAAGGACAAGACC<br>AGCACCGTCGAGGCCTGTCTCCCCCTGGAGCTGACCAAGAATGAGAGCTGCCTGAA<br>CAGCCGGGAGACCAGCTTCATCACCAACGGGAGCTGCCTGGCCTCCAGGAAGACCT<br>CGTTCATGATGGCGCTGTGCCTCTCAAGCATATACGAGGATCTGAAGATGTACCAG<br>GTGGAGTTTAAGACGATGAACGCCAAGCTGCTGATGGACCCGAAGAGGCAGATCTT<br>CCTGGACCAGAACATGCTGGCCGTGATAGACGAGCTCATGCAGGCCCTGAACTTCA |

| SEQ ID NO | Description | Sequence |
|---|---|---|
| | | ACTCCGAGACCGTGCCGCAGAAGTCATCCCTCGAGGAGCCCGACTTCTATAAGACC<br>AAGATCAAGCTGTGCATCCTGCTCCACGCCTTCCGGATAAGGGCCGTGACGATCGA<br>CAGGGTGATGAGCTACCTTAACGCCAGC |
| 30 | hIL12AB_026 ORF | ATGTGCCACCAGCAGCTCGTGATCAGCTGGTTCTCCCTGGTGTTTCTCGCCAGCCC<br>CCTGGTGGCCATCTGGGAGCTGAAGAAGGACGTGTACGTGGTGGAGCTGGACTGGT<br>ACCCTGACGCCCCGGGGAGATGGTCGTGCTGACCTGCGACACCCCCGAAGAGGAC<br>GGTATCACCTGGACCCTGGACCAGTCCAGCGAGGTGCTGGGCAGCGGCAAGACCCT<br>GACTATTCAAGTCAAGGAGTTCGGAGACGCCGGCCAGTACACCTGCCACAAGGGTG<br>GAGAGGTGTTATCACACAGCCTGCTGCTGCTGCACAAGAAGGAAGACGGGATCTGG<br>AGCACCGACATCCTGAAGGACCAGAAGGAGCCCAAAAACAAGACCTTCCTGCGGTG<br>CGAGGCCAAGAACTATTCGGGCCGCTTTACGTGCTGGTGGCTGACCACCATCAGCA<br>CTGATCTCACCTTCAGCGTGAAGTCCTCCCCGGGGGTCGTCCGACCCCCAGGGGGTG<br>ACCTGCGGGGCCGCCACCCTGTCCGCCGAGAGAGTGAGGGGCGATAATAAGGAGTA<br>CGAGTACAGCGTTGAGTGCCAGGAAGATAGCGCCTGTCCCGCCGCCGAGGAGAGCC<br>TGCCCATCGAGGTGATGGTGGACGCCGTCCACAAGCTGAAGTATGAGAACTACACC<br>TCAAGCTTCTTCATCAGGGACATCATCAAACCCGATCCGCCCAAGAATCTGCAGCT<br>GAAGCCCCTGAAAAATAGCAGGCAGGTGGAGGTGAGCTGGGAGTACCCCGACACCT<br>GGTCCACCCCCCATAGCTATTTCTCCCTGACGTTCTGCGTGCAGGTGCAAGGGAAG<br>AGCAAGCGGGAGAAGAAGGACCGGGTGTTCACCGACAAGACCTCCGCCACCGTGAT<br>CTGTAGGAAGAACGCGTCGATCTCGGTCAGGGCCCAGGACAGGTATTACAGCAGCA<br>GCTGGAGCGAGTGGGCGAGCGTGCCCTGCTCGGCGGCGGCGGCGGCGGGAGCAGA<br>AATCTGCCCGTGGCCACCCCAGACCCCGGAATGTTCCCCTGCCTGCACCATTCGCA<br>GAACCTCCTGAGGGCCGTGAGCAACATGCTGCAGAAGGCCCGCCAGACGCTGGAGT<br>TCTACCCCTGCACGAGCGAGGAGATCGACCACGAAGACATCACCAAGGACAAAACC<br>AGCACCGTGGAGGCCTGCCTGCCCCTGGAGCTGACCAAAAACGAATCCTGCCTCAA<br>CAGCCGGGAGACCAGCTTCATCACCAACGGCAGCTGCCTGGCCAGCCGAAAGACCT<br>CCTTCATGATGGCCCTCTGCCTGAGCAGCATCTATGAGGATCTGAAGATGTATCAG<br>GTGGAGTTCAAGACCATGAATGCCAAGCTGCTGATGGACCCCAAGAGGCAGATATT<br>CCTGGACCAGAATATGCTGGCCGTGATCGACGAGCTGATGCAGGCCCTGAACTTCA<br>ACAGCGAGACCGTCCCCCAGAAGTCCAGCCTGGAGGAGCCGGACTTTTACAAAACG<br>AAGATCAAGCTGTGCATACTGCTGCACGCCTTCAGGATCCGGGCCGTGACAATCGA<br>CAGGGTGATGTCCTACCTGAACGCCAGC |
| 31 | hIL12AB_027 ORF | ATGTGTCACCAGCAGCTGGTGATCAGCTGGTTCTCCCTGGTGTTCCTGGCCAGCCC<br>CCTGGTGGCCATCTGGGAGCTCAAGAAGGACGTCTACGTCGTGGAGCTGGATTGGT<br>ACCCCGACGCTCCCGGGGAGATGGTGGTGCTGACCTGCGACACCCCCGAGGAGGAC<br>GGCATCACCTGGACGCTGGACCAGAGCTCAGAGGTGCTGGGAAGCGGAAAGACACT<br>GACCATCCAGGTGAAGGAGTTCGGGGATGCCGGGCAGTATACCTGCCACAAGGGCG<br>GCGAAGTGCTGAGCCATTCCCTGCTGCTGCTGCACAAGAAGGAGGACGGCATATGG<br>TCCACCGACATCCTGAAGGATCAGAAGGAGCCGAAGAATAAAACCTTCCTGAGGTG<br>CGAGGCCAAGAATTACAGCGGGCCGATTCACCTGCTGGTGGCTGACCACCATCAGCA<br>CCGACCTGACCTTCAGTGTGAAGTCCTCACGGGGCAGCTCAGATCCCCAGGGCGTG<br>ACCTGCGGGCCGCGACACTCAGCGCCGAGCGGGTGAGGGGTGATAACAAGGAGTA<br>CGAGTATTCTGTGGAGTGCCAGGAAGACTCCGCCTGTCCCGCCGCCGAGGAGTCCC<br>TGCCCATCGAGGTGATGGTGGACGCCGTGCATAAACTGAAGTACGAGAACTACACC<br>TCCAGCTTCTTCATCCGGGATATAATCAAGCCCGACCCTCCGAAAAACCTGCAGCT<br>GAAGCCCCTTAAAAACAGCCGGCAGGTGGAGGTGAGCTGGGAGTACCCCGACACCT<br>GGAGCACCCCCCATAGCTATTTCAGCCTGACCTTCTGCGTGCAGGTGCAGGGGAAG<br>TCCAAGCGCGAGAAAAAGGACCGGGTGTTCACCGACAAGACGAGCGCCACCGTGAT<br>CTGCCGGAAGAACGCCAGTATAAGCGTAAGGGCCCAGGATAGGTACTACAGCTCCA<br>GCTGGTCGGAGTGGGCCTCCGTGCCCTGTTCCGGCGGCGGGGGGGTGGCAGCAGG<br>AACCTCCCCGTGGCCACGCCGGACCCCGGCATGTTCCCGTGCCTGCACCACTCCCA<br>AAACCTCCTGCGGGCCGTCAGCAACATGCTGCAAAAGGCGCGGCAGACCCTGGAGT<br>TTTACCCCTGTACCTCCGAAGAGATCGACCACGAGGATATCACCAAGGATAAGACC<br>TCCACCGTGGAGGCCTGTCTCCCCCTGGAGCTGACCAAGAACGAGAGCTGTCTTAA<br>CAGCAGAGAGACCTCGTTCATAACGAACGGCTCCTGCCTCGCTTCCAGGAAGACGT<br>CGTTCATGATGGCGCTGTGCCTGTCCAGCATCTACGAGGACCTGAAGATGTATCAG<br>GTCGAGTTCAAAACCATGAACGCCAAGCTGCTGATGGACCCCAAGAGGCAGATCTT<br>CCTGGACCAGAACATGCTCGCCGTGATCGACGAGCTGATGCAGGCCCTGAACTTCA<br>ACAGCGAAACCGTGCCCCAGAAGTCAAGCCTGGAGGAGCCGGACTTCTATAAGACC<br>AAGATCAAGCTGTGTATCCTGCTACACGCTTTTCGTATCCGGGCCGTGACCATCGA<br>CAGGGTTATGTCGTACTTGAACGCCAGC |
| 32 | hIL12AB_028 ORF | ATGTGCCACCAACAGCTCGTGATCAGCTGGTTCAGCCTGGTGTTCCTGGCCAGCCC<br>GCTGGTGGCCATCTGGGAGCTGAAGAAGGACGTGTACGTGGTGGAGCTGGACTGGT<br>ACCCCGACGCCCCCGGCGAGATGGTGGTCCTGACCTGCGACACGCCGAAGAGGAC<br>GGCATCACCTGGACCCTGGATCAGTCCAGCGAGGTGCTGGGCTCCGGCAAGACCCT<br>GACCATTCAGGTGAAGGAGTTCGGCGACGCCGGTCAGTACACCTGCCACAAGGGCG<br>GCGAGGTGCTGAGCCACAGCTACTGCTCCTGCACAAAAAGGAGGATGGAATCTGG<br>TCCACCGACATCCTCAAGGACCAGAAGGAGCCGAAGAACAAGACGTTCCTCCGGTG<br>CGAGGCCAAGAACTACAGCGGCAGGTTTACCTGCTGGTGGCTGACCACCATCAGCA<br>CCGACCTGACATTTTCCGTGAAGAGCAGCCGCGGCAGCAGCGATCCCCAGGGCGTG |

SUMMARY OF SEQUENCES

| SEQ ID NO | Description | Sequence |
|---|---|---|
| | | ACCTGCGGGGCGGCCACCCTGTCCGCCGAGCGTGTGAGGGGCGACAACAAGGAGTA
CGAGTACAGCGTGGAATGCCAGGAGGACAGCGCCTGTCCCGCCGCCGAGGAGAGCC
TGCCAATCGAGGTCATGGTGGACGCCGTGCACAAGCTGAAGTACGAGAACTACACG
AGCAGCTTCTTCATCAGGGACATCATCAAACCGGACCCGCCCAAGAACCTGCAGCT
GAAACCCTTGAAAAACAGCAGGCAGGTGGAAGTGTCTTGGGAGTACCCCGACACCT
GGTCCACCCCCACAGCTACTTTAGCCTGACCTTCTGTGTGCAGGTCCAGGGCAAG
TCCAAGAGGGAGAAGAAGGACAGGGTGTTCACCGACAAAACCAGCGCCACCGTGAT
CTGCAGGAAGAACGCCTCCATCAGCGTGCGGGCCCAGGACAGGTATTACAGCTCGT
CGTGGAGCGAGTGGGCCAGCGTGCCCTGCTCCGGGGAGGCGGCGGCGGAAGCCGG
AATCTGCCCGTGGCCACCCCCGATCCCGGCATGTTCCCGTGTCTGCACCACAGCCA
GAACCTGCTGCGGGCCGTGAGCAACATGCTGCAGAAGGCCCGCCAAACCCTGGAGT
CTACCCCTGTACAAGCGAGGAGATCGACCATGAGGACATTACCAAGGACAAGACC
AGCACCGTGGAGGCCTGCCTGCCCCTCGAGCTCACAAAGAACGAATCCTGCCTGAA
TAGCCGCGAGACCAGCTTTATCACGAACGGGTCCTGCCTCGCCAGCCGGAAGACAA
GCTTCATGATGGCCCTGTGCCTGAGCAGCATCTACGAGGACCTGAAAATGTACCAA
GTGGAGTTCAAAACGATGAACGCCAAGCTGCTGATGGACCCCAAGCGCCAGATCTT
CCTGGACCAGAACATGCTGGCCGTCATCGACGAGCTCATGCAGGCCCTGAACTTCA
ACAGCGAGACCGTGCCCCAGAAGAGCAGCCTGGAGGAGCCCGACTTCTACAAGACG
AAGATCAAGCTCTGCATCCTGCTGCACGCTTTCCGCATCCGCGCGGTGACCATCGA
CCGGGTGATGAGCTACCTCAACGCCAGT |
| 33 | hIL12AB_029 ORF | ATGTGCCACCAACAGCTGGTGATCAGCTGGTTCAGCCTGGTGTTTCTGGCCTCCCC
TCTGGTGGCCATCTGGGAGCTGAAGAAGGACGTGTACGTGGTGGAGCTGGACTGGT
ACCCTGACGCCCCCGGCGAAATGGTGGTGCTGACGTGCGACACCCCCGAGGAGGAT
GGCATCACCTGGACCCTGGACCAAAGCAGCGAGGTCCTCGGAAGCGGCAAGACCCT
CACTATCCAAGTGAAGGAGTTCGGGGATGCGGGCCAGTACACCTGCCACAAGGGCG
GCGAGGTGCTGTCTCATAGCCTGCTGCTCCTGCATAAGAAGGAAGACGGCATCTGG
AGCACCGACATACTGAAGGATCAGAAGGAGCCCAAGAACAAGACCTTCCTGAGGTG
CGAGGCCAAGAACTACTCCGGGCGCTTCACCTGTTGGTGGCTGACCACCATCTCCA
CCGACCTGACCTTCAGCGTGAAGAGCAGCAGGGGGAGCAGCGACCCCCAGGGGGTG
ACCTGCGGAGCCGCGACCTTGTCGGCCGAGCGGGTGAGGGGCGACAATAAGGAGTA
CGAGTACTCGGTGAATGCCAGGAGGACTCCGCCTGCCCCGCCGCCGAGGAGTCCC
TCCCCATCGAAGTGATGGTGGACGCCGTCCACAAGCTGAAGTACGAGAACTACACC
AGCAGCTTCTTCATACGGGATATCATCAAGCCCGACCCCCCGAAGAACCTGCAGCT
GAAACCCTTGAAGAACTCCAGGCAGGTGGAGGTGAGCTGGGAGTACCCCGACACCT
GGTCCACCCCGCACTCATACTTCAGCCTGACCTTCTGTGTACAGGTCCAGGGCAAG
AGCAAGAGGGAAAAGAAGGATAGGGTGTTCACCGACAAGACCTCCGCCACGGTGAT
CTGTCGGAAAAACGCCAGCATCTCCGTGCGGGCCCAGGACAGGTACTATTCCAGCA
GCTGGAGCGAGTGGGCCTCCGTCCCCTGCTCCGGCGGCGGTGGCGGGGGCAGCAGG
AACCTCCCCGTGGCCACCCCCGATCCCGGGATGTTCCCATGCCTGCACCACAGCCA
AAACCTGCTGAGGGCCGTCTCCAATATGCTGCAGAAGGCGAGGCAGACCCTGGAGT
TCTACCCCTGTACCTCCGAGGAGATCGACCACGAGGATATCACCAAGGACAAGACC
TCCACGGTCGAGGCGTGCCTGCCCCTGGAGCTCACGAAGAACGAGAGCTGCCTTAA
CTCCAGGGAAACCTCGTTTATCACGAACGGCAGCTGCCTGGCGTCACGGAAGACCT
CCTTTATGATGGCCCTATGTCTGTCCTCGATCTACGAGGACCTGAAGATGTACCAG
GTGGAGTTCAAGACCATGAACGCCAAGCTGCTGATGGATCCCAAGAGGCAGATTTT
CCTGGACCAGAACATGCTGGCCGTGATTGACGAGCTGATGCAGGCGCTGAACTTCA
ACAGCGAGACAGTGCCGCAGAAGAGCTCCCTGGAGGAGCCGGACTTTTACAAGACC
AAGATAAAGCTGTGCATCCTGCTCCACGCCTTCAGAATACGGGCCGTCACCATCGA
TAGGGTGATGTCTTACCTGAACGCCTCC |
| 34 | hIL12AB_030 ORF | ATGTGCCACCAGCAGCTGGTGATTAGCTGGTTTAGCCTGGTGTTCCTGGCAAGCCC
CCTGGTGGCCATCTGGGAACTGAAAAAGGACGTGTACGTGGTGGAGCTGGATTGGT
ACCCCGACGCCCCCGGCGAAATGGTGGTGCTGACGTGTGATACCCCCGAGGAGGAC
GGGATCACCTGGACCCTGGATCAGAGCAGCGAGGTGCTGGGGAGCGGGAAGACCCT
GACGATCCAGGTCAAGGAGTTCGGCGACGCTGGGCAGTACACCTGTCACAAGGGCG
GGGAGGTGCTGTCCCACTCCCTGCTGCTCCTGCATAAGAAAGAGGACGGCATCTGG
TCCACCGACATCCTCAAGGACCAGAAGGAGCCCAAGAACAAGACCTTCCTGCGGTG
TGAGGCGAAGAACTACAGCGGCCGTTTCACCTGCTGGTGGCTGACGACAATCAGCA
CCGACTTGACGTTCTCCGTGAAGTCCTCCAGAGGCAGCTCCGACCCCCAAGGGGTG
ACGTGCGGCGCGGCCACCCTGAGCGCCGAGCGGGTGCGGGGGGACAACAAGGAGTA
CGAGTACTCCGTGGAGTGCCAGGAGGACAGCGCCTGTCCCGCAGCCGAGGAGTCCC
TGCCCATCGAAGTCATGGTGGACGCCGTCCACAAGCTGAAGTACGAGAACTACACC
AGCAGCTTCTTCATCCGCGATATCATCAAGCCCGATCCCCCCAAAAACCTGCAACT
GAAGCCGCTGAAGAATAGCAGGCAGGTGGAGGTGTCCTGGGAGTACCCGGACACCT
GGAGCACGCCCCACAGCTATTTCAGCCTGACCTTTTGCGTGCAGGTCCAGGGGAAG
AGCAAGCGGGAGAAGAAGGACCGCGTGTTTACGGACAAAACCAGCGCCACCGTGAT
CTGCAGGAAGAACGCCAGCATCAGCGTGAGGGCCCAGGACAGGTACTACAGCAGCT
CCTGGAGCGAGTGGGCCTCCGTGCCCTGTTCCGGAGGCGGCGGGGGCGGTTCCCGG
AACCTCCCGGTGGCCACCCCCGACCCGGGCATGTTCCCGTGCCTGCACCACTCACA
GAATCTGCTGAGGGCCGTGAGCAATATGCTGCAGAAGGCAAGGCAGACCCTGGAGT
TTTATCCCTGCACCAGCGAGGAGATCGACCACGAAGACATCACCAAGGACAAGACC
AGCACAGTGGAGGCCTGCCTGCCCCTGGAACTGACCAAGAACGAGTCCTGTCTGAA |

SUMMARY OF SEQUENCES

| SEQ ID NO | Description | Sequence |
|---|---|---|
| | | CTCCCGGGAAACCAGCTTCATAACCAACGGCTCCTGTCTCGCCAGCAGGAAGACCA<br>GCTTCATGATGGCCCTGTGCCTCAGCTCCATCTACGAGGACCTCAAGATGTACCAG<br>GTTGAGTTCAAGACCATGAACGCCAAGCTCCTGATGGACCCCAAGAGGCAGATCTT<br>CCTGGACCAGAATATGCTGGCCGTGATCGATGAGTTAATGCAGGCGCTGAACTTCA<br>ACAGCGAGACGGTGCCCCAAAAGTCCTCGCTGGAGGAGCCCGACTTCTACAAGACC<br>AAGATCAAGCTGTGCATCCTCCTGCACGCCTTCCGAATCCGGGCCGTAACCATCGA<br>CAGGGTGATGAGCTATCTCAACGCCTCC |
| 35 | hIL12AB_031 ORF | ATGTGCCACCAGCAGCTCGTGATCAGCTGGTTCTCGCTTGTGTTCCTGGCCTCCCC<br>CCTCGTCGCCATCTGGGAGCTGAAGAAAGACGTGTACGTGGTGGAGCTGGACTGGT<br>ATCCCGACGCCCCGGGGGAGATGGTGGTGCTGACCTGCGACACCCCGGAAGAGGAC<br>GGCATCACCTGGACGCTCGACCAGTCGTCCGAAGTGCTGGGGTCGGGCAAGACCCT<br>CACCATCCAGGTGAAGGAGTTCGGAGACGCCGGCCAGTACACCTGTCATAAGGGGG<br>GGGAGGTGCTGAGCCACAGCCTCCTGCTCCTGCACAAAAAGGAGGACGGCATCTGG<br>AGCACCGATATCCTCAAGGACCAGAAGGAGCCCAAGAACAAGACGTTCCTGAGGTG<br>TGAGGCCAAGAACTACAGCGGGCGGTTCACGTGTTGGTGGCTCACCACCATCTCCA<br>CCGACCTCACCTTCTCCGTGAAGTCAAGCAGGGGCAGCTCCGACCCCCAAGGCGTC<br>ACCTGCGGCGCCGCCACCCTGAGCGCCGAGAGGGTCAGGGGGGATAACAAGGAATA<br>CGAGTACAGTGTGGAGTGCCAAGAGGATAGCGCCTGTCCCGCCGCCGAAGAGAGCC<br>TGCCCATCGAAGTGATGGTGGACGCCGTGCACAAGCTGAAGTACGAGAACTACACC<br>TCCAGCTTCTTCATCAGGGATATCATCAAGCCCGATCCCCCCAAGAACCTGCAGCT<br>GAAGCCCCTGAAGAACAGCAGGCAGGTGGAGGTGAGCTGGGAGTATCCCGACACGT<br>GGAGCACCCCGCACAGCTACTTCTCGCTGACCTTCTGCGTGCAGGTGCAAGGGAAG<br>TCCAAGAGGGAGAAGAAGGATAGGGTGTTCACCGACAAAACGAGCGCCACCGTGAT<br>CTGCCGGAAGAATGCCAGCATCTCTGTGAGGGCCCAGGACAGGTACTATTCCAGCT<br>CCTGGTCGGAGTGGGCCAGCGTGCCCTGTAGCGGCGGGGGCGGGGCGGCAGCAGG<br>AACCTCCCGGTTGCCACCCCCGACCCCGGCATGTTTCCGTGCCTGCACCACTCGCA<br>AAACCTGCTGCGCGCGGTCTCCAACATGCTGCAAAAAGCGCGCCAGACGCTGGAGT<br>TCTACCCCTGCACCAGCGAGGAGATCGATCATGAAGATATCACCAAAGACAAGACC<br>TCGACCGTGGAGGCCTGCCTGCCCCTGGAGCTCACCAAGAACGAAAGCTGCCTGAA<br>CAGCAGGGAGACAAGCTTCATCACCAACGGCAGCTGCCTGGCCTCCCGGAAGACCA<br>GCTTCATGATGGCCCTGTGCCTGTCCAGCATCTACGAGGATCTGAAGATGTACCAA<br>GTGGAGTTTAAGACCATGAACGCCAAGCTGTTAATGGACCCCAAAAGGCAGATCTT<br>CCTGGATCAGAACATGCTGGCCGTCATCGACGAGCTGATGCAAGCCCTGAACTTCA<br>ACAGCGAGACGGTGCCCCAGAAGAGCAGCCTCGAGGAGCCCGACTTCTATAAGACC<br>AAGATAAAGCTGTGCATTCTGCTGCACGCCTTCAGAATCAGGGCCGTGACCATCGA<br>TAGGGTGATGAGCTACCTGAACGCCAGC |
| 36 | hIL12AB_032 ORF | ATGTGTCACCAGCAGCTGGTGATTTCCTGGTTCAGTCTGGTGTTTCTTGCCAGCCC<br>CCTGGTGGCCATCTGGGAGCTGAAGAAAGACGTATACGTCGTGGAGCTGGACTGGT<br>ATCCCGACGCTCCCGGCGAGATGGTGGTCCTCACCTGCGACACCCCAGAGGAGGAC<br>GGCATCACCTGGACCCTGGACCAGAGCTCCGAGGTCCTGGGCAGCGGTAAGACCCT<br>CACCATCCAGGTGAAGGAGTTTGGTGATGCCGGGCAGTATACCTGCCACAAGGGCG<br>GCGAGGTGCTGTCCCACAGCCTCCTGTTACTGCATAAGAAGGAGGATGGCATCTGG<br>AGCACCGACATCCTCAAGGACCAGAAAGAGCCCAAGAACAAGACCTTTCTGCGGTG<br>CGAGGCGAAAAATTACTCCGGCCGGTTCACCTGCTGGTGGCTGACCACCATCAGCA<br>CGGACCTGACGTTCTCCGTGAAGTCGAGCAGGGGGAGCTCCGATCCCCAGGGCGTG<br>ACCTGCGGCGCGGCCACCCTGAGCGCCGAGCGCGTCCGCGGGGACAATAAGGAATA<br>CGAATATAGCGTGGAGTGCCAGGAGGACAGCGCCTGCCCCGCGGCCGAGGAGAGCC<br>TCCCGATCGAGGTGATGGTGGATGCCGTCCACAAGCTCAAATACGAAAACTACACC<br>AGCAGCTTCTTCATTAGGGACATCATCAAGCCCGACCCCCCCAAAAACCTGCAGCT<br>GAAGCCCCTGAAGAACAGCCGCCAGGTCGAGGTGTCATGGGAGTACCCAGACACCT<br>GGAGCACCCCCCACTCCTACTTCAGCCTGACCTTCTGCGTCCAGGTGCAGGGAAAG<br>TCCAAACGGGAGAAGAAGGATAGGGTCTTTACCGATAAGACGTCGGCCACCGTCAT<br>CTGCAGGAAGAACGCCAGCATAAGCGTGCGGGCGCAGGATCGGTACTACAGCTCGA<br>GCTGGTCCGAATGGGCCTCCGTGCCCTGTAGCGGAGGGGTGGCGGGGGCAGCAGG<br>AACCTGCCCGTGGCCACCCCGGACCCGGGCATGTTTCCCTGCCTGCATCACAGTCA<br>GAACCTGCTGAGGGCGTGAGCAACATGCTCCAGAAGGCCCGCCAGAGACCCTGGAGT<br>TTTACCCCTGCACCAGCGAAGAGATCGATCACGAAGACATCACCAAAGACAAGACC<br>TCCACCGTGGAGGCCTGTCTGCCCCTGGAGCTGACCAAGAACGAGAGCTGTCTGAA<br>CAGCAGGGAGACCTCCTTCATCACCAACGGCTCCTGCCTGGCATCCCGGAAGACCA<br>GCTTCATGATGGCCCTGTGTCTGAGCTCTATCTACGAGGACCTGAAGATGTACCAG<br>GTCGAGTTCAAGACCATGAACGCCAAGCTGCTGATGGACCCCAAGCGACAGATATT<br>CCTGGACCAGAACATGCTCGCCGTGATCGATGAACTGATGCAAGCCCTGAACTTCA<br>ATAGCGAGACCGTGCCCCAGAAAAGCAGCCTGGAGGAGCCCGACTTCTACAAGACC<br>AAGATCAAACTGTGCATACTGCTGCACGCGTTCAGGATCCGGGCCGTCACCATCGA<br>CCGGGTGATGTCCTATCTGAATGCCAGC |
| 37 | hIL12AB_033 ORF | ATGTGCCACCAGCAGCTCGTGATTAGCTGGTTTTCGCTGGTGTTCCTGGCCAGCCC<br>TCTCGTGGCCATCTGGGAGCTGAAAAAGACGTACGTGGTGGAGCTGGACTGGT<br>ACCCGGACGCCCCCGGCGAGATGGTGGTGCTGACGTGCGACACCCCGGAAGAGGAC<br>GGCATCACCTGGACCCTGGACCAGTCATCCGAGGTCCTGGGCAGCGGCAAGACGCT<br>CACCATCCAGGTGAAGGAGTTCGGCGACGCCGGCCAGTACACATGCCATAAGGGCG |

SUMMARY OF SEQUENCES

| SEQ ID NO | Description | Sequence |
|---|---|---|
| | | GGGAGGTGCTGAGCCACAGCCTGCTCCTCCTGCACAAGAAGGAGGATGGCATCTGG<br>TCTACAGACATCCTGAAGGACCAGAAAGAGCCCAAGAACAAGACCTTCCTCCGGTG<br>CGAGGCCAAGAACTACTCCGGGCGGTTTACTTGTTGGTGGCTGACCACCATCAGCA<br>CCGACCTCACCTTCAGCGTGAAGAGCTCCCGAGGGAGCTCCGACCCCCAGGGGGTC<br>ACCTGCGGCGCCGCCACCCTGAGCGCCGAGCGGGTGAGGGGCGACAACAAGGAGTA<br>TGAATACAGCGTGGAATGCCAAGAGGACAGCGCCTGTCCCGCGGCCGAGGAAAGCC<br>TGCCCATCGAGGTGATGGTGGACGCCGTCCACAAACTCAAGTACGAGAACTACACC<br>AGCAGTTTCTTCATTCGCGACATCATCAAGCCGGACCCCCCCAAAAACCTGCAGCT<br>CAAACCCCTGAAGAACAGCAGGCAGGTGGAGGTCAGCTGGGAGTACCCGGACACCT<br>GGAGCACCCCCCATAGCTACTTCAGCCTGACCTTCTGCGTGCAGGTGCAGGGCAAG<br>AGCAAACGCGAGAAGAAGGACCGGGTGTTTACCGACAAGACCAGCGCCACGGTGAT<br>CTGCCGAAAGAATGCAAGCATCTCCGTGAGGGCGCAGGACCGCTACTACTCTAGCA<br>GCTGGAGCGAGTGGGCCAGCGTGCCCTGCAGCGGTGGCGGCGGAGGCGGCAGCCGT<br>AACCTCCCCGTGGCCACCCCCGACCCGGCATGTTCCCGTGTCTGCACCACTCCCA<br>GAACCTGCTGAGGGCCGTCAGCAATATGCTGCAGAAGGCCCGGCAGACGCTGGAGT<br>TCTACCCCTGCACCTCCGAGGAGATCGACCATGAGGACATTACCAAGGACAAGACG<br>AGCACTGTGGAGGCCTGCCTGCCCCTGGAGCTCACCAAAAACGAGAGCTGCCTGAA<br>TAGCAGGGAGACGTCCTTCATCACCAACGGCAGCTGTCTGGCCAGCAGGAAGACCA<br>GCTTCATGATGGCCCTGTGCCTCTCCTCCATATATGAGGATCTGAAGATGTACCAG<br>GTGGAGTTCAAGACCATGAACGCCAAGCTGCTGATGGATCCCAAGAGGCAGATCTT<br>CCTGGACCAGAATATGCTGGCCGTGATTGACGAGCTGATGCAGGCCCTGAACTTTA<br>ATAGCGAGACCGTCCCCCAGAAGAGCAGCCTGGAGGAGCCCGACTTCTATAAGACC<br>AAGATCAAGCTGTGCATACTGCTGCACGCGTTTAGGATAAGGGCCGTCACCATCGA<br>CAGGGTGATGAGCTACCTGAATGCCAGC |
| 38 | hIL12AB_034 ORF | ATGTGCCACCAACAGCTGGTGATCTCCTGGTTCAGCCTGGTGTTCCTCGCCAGCCC<br>CCTGGTGGCCATCTGGGAGCTGAAGAAAGACGTGTACGTGGTGGAGCTGGACTGGT<br>ATCCCGACGCCCCCGGCGAGATGGTCGTGCTGACCTGCGACACCCCCGAGGAGGAC<br>GGCATCACCTGGACCCTGGATCAGTCCTCCGAGGTGCTGGGCAGCGGGAAGACCCT<br>GACCATCCAGGTGAAAGAGTTCGGAGATGCCGGCCAGTATACCTGTCACAAGGGGG<br>GTGAGGTGCTGAGCCATAGCCTCTTGCTTCTGCACAAGAAGGAGGACGGCATCTGG<br>TCCACCGACATCCTCAAGGACCAAAAGGAGCCGAAGAATAAAACGTTCCTGAGGTG<br>CGAAGCCAAGAACTATTCCGGACGGTTCACCTGCTGGTGGCTGACCACCATCAGCA<br>CCGACCTCACCTTCTCCGTAAAGTCAAGCAGGGGCAGCTCCGACCCCCAGGGCGTG<br>ACCTGCGGAGCCGCCACCCTGAGCGCAGAGAGGGTGAGGGGCGACAACAAGGAGTA<br>CGAATACTCCGTCGAGTGCCAGGAGGACAGCGCCTGCCCCGCCGCCGAGGAAAGTC<br>TGCCCATCGAGGTGATGGTGGACGCCGTGCACAAGCTCAAATACGAGAACTACACC<br>AGCAGCTTCTTCATCCGGGATATCATCAAGCCCGACCCTCCAAAGAATCTGCAGCT<br>GAAACCCCTTAAGAACAGCAGGCAGGTGGAGGTCAGCTGGGAGTACCCCGACACCT<br>GGAGCACGCCCCACTCCTACTTTAGCCTGACCTTTTGCGTGCAGGTGCAGGGGAAA<br>AGCAAGCGGGAGAAGAAGGACAGGGTGTTCACCGATAAGACCTCCGCTACCGTGAT<br>CTGCAGGAAGAACGCCTCAATCAGCGTGAGGGCCCAGGATCGGTACTACTCCAGCT<br>CCTGGAGCGAGTGGGCCAGCGTGCCCTGCTCGGCGGTGGCGGCGGGGCAGCCGG<br>AACCTGCCGGTGGCCACTCCCGACCCGGGCATGTTCCCGTGCCTCCACCATTCCCA<br>GAACCTGCTGCGGGCCGTGTCCAATATGCTCCAGAAGGCAAGGCAGACCCTGGAGT<br>TCTACCCCTGCACCAGCGAGGAGATCGATCACGAGGACATCACCAAAGACAAAACC<br>AGCACGGTCGAGGCCTGCCTGCCCCTGGAACTCACCAAGAACGAAAGCTGTCTCAA<br>CAGCCGCGAGACCAGCTTCATAACCAACGGTTCCTGTCTGGCCTCCCGCAAGACCA<br>GCTTTATGATGGCCCTCTGTCTGAGCTCCATCTATGAAGACCTGAAAATGTACCAG<br>GTGGAGTTCAAAACCATGAACGCCAAGCTTCTGATGGACCCCAAGAGGCAGATCTT<br>CCTGGATCAGAACATGCTGGCCGTGATCGACGAGCTGATGCAGGCCCTGAACTTTA<br>ACTCCGAGACCGTGCCCCAGAAAAGCAGCCTGGAAGAGCCCGATTTCTACAAAACG<br>AAGATCAAGCTGTGCATCCTGCTGCACGCCTTCCGGATCCGTGCGGTGACCATCGA<br>TAGGGTGATGAGCTACCTGAACGCCAGC |
| 39 | hIL12AB_035 ORF | ATGTGCCACCAACAGCTGGTAATCAGCTGGTTCAGCCTGGTTTTCCTCGCGTCGCC<br>CCTGGTGGCCATCTGGGAGTTAAAGAAGGACGTGTACGTGGTGGAGCTGGATTGGT<br>ACCCCGACGCCCCGGGCGAGATGGTCGTGCTCACCTGCGATACCCCCGAGGAGGAC<br>GGGATCACCTGGACCCTGGACCAATCCAGCGAGGTGCTGGGCAGCGGCAAGACCCT<br>GACCATACAGGTGAAGGAATTTGGGGACGCCGGGCAGTACACCTGCCACAAGGGCG<br>GGGAAGTGCTGTCCCACTCCCTCCTGCTGCTGCATAAGAAGGAGGACGGCATCTGG<br>AGCACCGACATCCTGAAGGACCAAAAGGAGCCCAAGAACAAGACCTTCCTGAGGTG<br>CGAGGCCAAAAACTATTCCGGCCGCTTTACCTGTTGGTGGCTGACCACCATCTCCA<br>CCGATCTGACCTTCAGCGTGAAGTCGTCTAGGGGCTCCTCCGACCCCCAGGGCGTA<br>ACCTGCGGCGCCGCGACCCTGAGCGCCGAGAGGGTGCGGGGCGATAACAAAGAGTA<br>CGAGTACTCGGTGGAGTGCCAGGAGGACAGCGCCTGTCCGGCGGCCGAGGAGAGCC<br>TGCCCATCGAGGTGATGGTGGACGCCGTCCACAAGCTGAAGTACGAGAACTACACC<br>AGTTCGTTCTTCATCAGGGACATCATCAAGCCGGACCCCCCCAAGAACCTCCAGCT<br>GAAGCCCCTGAAGAACAGCAGGCAGGTGGAAGTGTCCTGGGAGTATCCCGACACCT<br>GGAGCACCCCCCACAGCTACTTCAGCCTGACCTTTTGCGTGCAGGTGCAGGGCAAA<br>AGCAAGAGGGAAAAGAAGGACCGGGTGTTCACCGATAAGACGAGCGCCACCGTTAT<br>CTGCAGGAAGAACGCCTCCATAAGCGTGAGGGCGCAGGACCGTTACTACAGCAGCA<br>GCTGGAGTGAGTGGGCAAGCGTGCCCTGTAGCGGCGGGGGCGGGGCGGGTCCCGC |

| SEQ ID NO | Description | Sequence |
|---|---|---|
| | | AACCTCCCCGTCGCCACCCCCGACCCAGGCATGTTTCCGTGCCTGCACCACAGCCA<br>GAACCTGCTGCGGGCCGTTAGCAACATGCTGCAGAAGGCCAGGCAGACCCTCGAGT<br>TCTATCCCTGCACATCTGAGGAGATCGACCACGAAGACATCACTAAGGATAAGACC<br>TCCACCGTGGAGGCCTGTCTGCCCCTCGAGCTGACCAAGAATGAATCCTGCCTGAA<br>CAGCCGAGAGACCAGCTTTATCACCAACGGCTCCTGCCTGGCCAGCAGGAAGACCT<br>CCTTCATGATGGCCCTGTGCCTCTCCAGCATCTACGAGGATCTGAAGATGTACCAG<br>GTAGAGTTCAAGACGATGAACGCCAAGCTCCTGATGGACCCCAAGAGGCAGATATT<br>CCTGGACCAGAACATGCTGGCGGTGATCGACGAGCTGATGCAGGCCCTGAATTTCA<br>ACAGCGAGACGGTGCCACAGAAGTCCAGCCTGGAGGAGCCAGACTTCTACAAGACC<br>AAGATCAAACTGTGCATCCTCCTGCACGCGTTCAGGATCCGCGCCGTCACCATAGA<br>CAGGGTGATGAGTTATCTGAACGCCAGC |
| 40 | hIL12AB_036 ORF | ATGTGCCATCAGCAGCTGGTAATCAGCTGGTTTAGCCTGGTGTTCCTGGCCAGCCC<br>ACTGGTGGCCATCTGGGAGCTGAAGAAGGACGTGTACGTGGTGGAACTGGACTGGT<br>ACCCCGACGCCCCTGGCGAGATGGTGGTACTGACCTGTGACACCCCGGAGGAAGAC<br>GGTATCACCTGGACCCTGGATCAGAGCTCCGAGGTGCTGGGCTCCGGCAAGACACT<br>GACCATCCAAGTTAAGGAATTTGGGGACGCCGGCCAGTACACCTGCCACAAGGGGG<br>GCGAGGTGCTGTCCCACTCCCTGCTGCTTCTGCATAAGAAGGAGGATGGCATCTGG<br>TCCACCGACATACTGAAGGACCAGAAGGAGCCCAAGAATAAGACCTTCCTGAGATG<br>CGAGGCCAAGAACTACTCGGGAAGGTTCACCTGCTGGTGGCTGACCACCATCAGCA<br>CCGACCTGACCTTCTCCGTGAAGAGCTCCCGGGGCAGCTCCGACCCCCAGGGCGTA<br>ACCTGTGGGGCCGCTACCCTGTCCGCCGAGAGGGTCCGGGGCGACAACAAGGAATA<br>CGAGTACAGCGTGGAGTGCCAGGAGGACTCCGCCTGCCCCGCCGCCGAGGAGTCGC<br>TGCCCATAGAGGTGATGGTGGACGCCGTGCACAAGCTCAAGTACGAGAATTACACC<br>AGCAGCTTCTTTATCAGGGACATAATTAAGCCGGACCCCCCAAAGAATCTGCAGCT<br>GAAGCCCCTGAAGAATAGCCGGCAGGTGGAAGTGTCCTGGGAGTACCCCGACACCT<br>GGAGCACCCCCACTCCTATTTCTCACTGACATTCTGCGTGCAGGTGCAAGGGAAA<br>AGCAAGAGGGAGAAGAAGGATAGGGTGTTCACCGACAAGACAAGCGCCACCGTGAT<br>CTGCCGAAAAAATGCCAGCATCAGCGTGAGGGCCCAGGATCGGTATTACAGCAGCT<br>CCTGGAGCGAGTGGGCCAGCGTGCCCTGTTCCGGCGGGGAGGGGCGGCTCCCGG<br>AACCTGCCGGTGGCCACCCCCGACCCTGGCATGTTCCCTGCCTGCATCACAGCCA<br>GAACCTGCTCCGGGCCGTGTCGAACATGCTGCAGAAGGCCCGGCAGACCCTCGAGT<br>TTTACCCCTGCACCAGCGAAGAGATCGACCACGAAGACATAACCAAGGACAAGACC<br>AGCACGGTGGAGGCCTGCCTGCCCCTGGAGCTTACCAAAAACGAGTCCTGCCTGAA<br>CAGCCGGGAAACCAGCTTCATAACGAACGGGAGCTGCCTGGCCTCCAGGAAGACCA<br>GCTTCATGATGGCGCTGTGTCTGTCCAGCATATACGAGGATCTGAAGATGTATCAG<br>GTGGAATTCAAAACTATGAATGCCAAGCTCCTGATGGACCCCAAGAGGCAGATCTT<br>CCTGGACCAGAACATGCTAGCCGTGATCGACGAGCTGATGCAGGCCCTCAACTTCA<br>ACTCGGAGACGGTGCCCCAGAAGTCCAGCCTCGAGGAGCCCGACTTCTACAAGACC<br>AAGATCAAGCTGTGCATACTGCTGCATGCCTTCAGGATAAGGGCGGTGACTATCGA<br>CAGGGTCATGTCCTACCTGAACGCCAGC |
| 41 | hIL12AB_037 ORF | ATGTGCCACCAACAACTGGTGATCAGCTGGTTCTCCCTGGTGTTCCTGGCCAGCCC<br>CCTGGTGGCCATCTGGGAGCTCAAAAAAGACGTGTACGTGGTGGAGCTCGATTCGT<br>ACCCAGACGCGCCGGGGAAATGGTGGTGCTGACCTGCGACACCCCAGAGGAGGAT<br>GGCATCACGTGGACGCTGGATCAGTCCAGCGAGGTGCTGGGGAGCGGCAAGACGCT<br>CACCATCCAGGTGAAGGAATTTGGCGACGCGGGCCAGTATACCTGTCACAAGGGCG<br>GCGAGGTGCTGAGCCACTCCCTGCTGCTGCTGCACAAGAAGGAGGATGGGATCTGG<br>TCAACCGATATCCTGAAAGACCAGAAGGAGCCCAAGAACAAGACCTTCCTGCGCTG<br>CGAGGCCAAGAACTATAGCGGCAGGTTCACCTGCTGGTGGCTGACCACCATCAGCA<br>CCGACCTGACCTTCAGCGTGAAATCCTCCAGGGGCAGCAGCGACCCCCAGGGCGTG<br>ACCTGCGGTGCCGCCACGCTCTCCGCCGAGCGAGTGAGGGGTGACAACAAGGAGTA<br>CGAGTACAGCGTGGAATGTCAGGAGGACAGCGCCTGTCCCGCCGCCGAGGAGTCGC<br>TGCCCATCGAGGTGATGGTCGACGCGGTGCACAAGCTCAAATACGAGAATTACACC<br>AGCAGCTTCATCAGGGACATCATCAAGCCCGACCCCCCAAGAACCTGCAGCT<br>GAAGCCCTTGAAGAACAGCAGGCAGGTGGAGGTGAGCTGGGAGTACCCGGACACCT<br>GGAGCACCCCCCACTCCTACTTCAGCCTGACGTTCTGTGTGCAGGTGCAGGGGAAG<br>TCCAAGAGGGAGAAGAAGGACCGGGTGTTCACCGACAAGACCAGCGCCACCGTGAT<br>ATGCCGCAAGAACGCGTCCATCAGCGTTCGCGCCCAGGACCGCTACTACAGCAGCT<br>CCTGGTCCGAATGGGCCAGCGTGCCCTGCAGCGGTGGAGGGGGCGGGGCTCCAGG<br>AATCTGCCGGTGGCCACCCCCGACCCCGGGATGTTCCCGTGTCTGCATCACTCCCA<br>GAACCTGCTGCGGGCCGTGAGCAATATGCTGCAGAAGGCCAGGCAGACGCTCGAGT<br>TCTACCCCTGCACCTCCGAAGAGATCGACCATGAGGACATCACCAAGGACAAGACC<br>AGCACCGTGGAGGCCTGCCTCCCCCTGGAGCTGACCAAAAACGAGAGCTGCCTGAA<br>CTCCAGGGAGACCAGCTTTATAACCAACGGCAGCTGCCTCGCCTCCAGGAAGACCT<br>CGTTTATGATGGCCCTCTGCCTGTCCAGCATCTACGAGGACTGAAGATGTACCAG<br>GTGGAGTTCAAGACCATGAACGCGAAGTTGCTCATGGACCCCAAGAGGCAGATCTT<br>CCTGGACCAGAACATGCTCGCGGTGATCGACGAGCTGATGCAAGCCCTGAACTTCA<br>ACAGCGAGACCGTGCCCCAGAAGAGCAGCCTGGAAGAGCCCGACTTCTACAAGACC<br>AAGATCAAGCTGTGCATCCTGCTGCACGCCTTCCGGATCCGGGCCGTGACCATCGA<br>CAGGGTGATGAGCTACCTCAACGCCTCC |

-continued

SUMMARY OF SEQUENCES

| SEQ ID NO | Description | Sequence |
|---|---|---|
| 42 | hIL12AB_038 ORF | ATGTGCCACCAGCAGCTCGTGATCAGCTGGTTCTCCCTCGTCTTCCTGGCCTCCCC<br>GCTGGTGGCCATCTGGGAGCTGAAGAAGGACGTGTACGTGGTGGAGCTGGACTGGT<br>ATCCCGACGCCCCCGGCGAGATGGTGGTGCTGACGTGCGACACCACCAGAAGAGGAC<br>GGGATCACATGGACCCTGGATCAGTCGTCCGAGGTGCTGGGGAGCGGCAAGACCCT<br>CACCATCCAAGTGAAGGAGTTCGGGGACGCCGGCCAGTACACCTGCCACAAGGGCG<br>GGGAGGTGCTCTCCCATAGCCTGCTCCTCCTGCACAAAAAGGAGGATGGCATCTGG<br>AGCACCGACATCCTGAAGGACCAGAAGGAGCCCAAGAACAAGACATTTCTCAGGTG<br>TGAGGCCAAGAACTATTCGGGCAGGTTTACCTGTTGGTGGCTCACCACCATCTCTA<br>CCGACCTGACGTTCTCCGTCAAGTCAAGCAGGGGGAGCTCGGACCCCCAGGGGGTG<br>ACATGTGGGGCCGCCACCCTGAGCGCGGAGCGTGTCCGCGGCGACAACAAGGAGTA<br>CGAGTATTCCGTGGAGTGCCAGGAGGACAGCGCCTGCCCCGCCGCCGAGGAGTCCC<br>TGCCCATAGAGGTGATGGTGGACGCCGTCCACAAGTTGAAGTACGAAAATTATACC<br>TCCTCGTTCTTCATTAGGGACATCATCAAGCCTGACCCCCCGAAGAACCTACAACT<br>CAAGCCCCTCAAGAACTCCCGCCAGGTGGAGGTGTCCTGGGAGTACCCCGACACCT<br>GGTCCACCCCGCACAGCTACTTCAGCCTGACCTTCTGCGTGCAGGTCCAGGGGAAG<br>AGCAAGCGTGAAAAGAAAGCAGGGTGTTCACCGACAAGACGAGCGCCACCGTGAT<br>CTGCAGGAAAAACGCCTCCATCTCCGTGCGCGCCCAGGACAGGTACTACAGTAGCT<br>CCTGGAGCGAATGGGCCAGCGTGCCGTGCAGCGGCGGGGAGGAGGCGGCAGTCGC<br>AACCTGCCCGTGGCCACCCCCGACCCCGGCATGTTCCCATGCCTGCACCACAGCCA<br>GAACCTGCTGAGGGCAGTCAGCAATATGCTGCAGAAGGCCAGGCAGACCCTGGAGT<br>TTTATCCCTGCACCAGCGAGGAGATCGACCACGAGGACATCACCAAGGACAAGACC<br>TCCACCGTCGAGGCCTGCCTGCCACTGGAGCTGACCAAAAACGAGAGCTGCCTGAA<br>CTCCAGGGAGACCTCCTTCATCACCAACGGGAGCTGCCTGGCCAGCCGGAAGACCA<br>GCTTCATGATGGCGCTGTGCCTCAGCAGCATCTACGAGGATCTCAAGATGTACCAG<br>GTGGAGTTCAAGACCATGAACGCGAAGCTGCTGATGGACCCCAAGCGGCAGATCTT<br>CCTGGACCAGAACATGCTGGCCGTGATTGACGAGCTCATGCAGGCCCTGAACTTCA<br>ATAGCGAGACCGTCCCCCAAAAGAGCAGCCTGGAGGAACCCGACTTCTACAAAACG<br>AAGATCAAGCTCTGCATCCTGCTGCACGCCTTCCGGATCCGGGCCGTGACCATCGA<br>TCGTGTGATGAGCTACCTGAACGCCTCG |
| 43 | hIL12AB_039 ORF | ATGTGCCACCAGCAGCTCGTCATCTCCTGGTTTAGCCTGGTGTTTCTGGCCTCCCC<br>CCTGGTCGCCATCTGGGAGCTGAAGAAAGACGTGTACGTGGTGGAGCTGGACTGGT<br>ACCCGGACGCTCCCGGGGAGATGGTGGTGCTGACCTGCGACACCCCCGAGGAGGAC<br>GGCATCACCTGGACCCTGGACCAGAGCTCCGAGGTGCTGGGGAGCGGCAAGACCCT<br>GACCATTCAGGTGAAAGAGTTCGGCGACGCCGGCCAATATACCTGCCACAAGGGGG<br>GGGAGGTCCTGTCGCATTCCCTGCTGCTGCTTCACAAAAAGGAGGATGGCATCTGG<br>AGCACCGACATCCTGAAGGACCAGAAAGAACCCAAGAACAAGACGTTCCTGCGCTG<br>CGAGGCCAAGAACTACAGCGGCCGGTTCACCTGTTGGTGGCTGACCACCATCTCCA<br>CCGACCTGACTTTCTCGGTGAAGAGCAGCCGCGGGAGCAGCGACCCCCAGGGAGTG<br>ACCTGCGGCGCCGCCACCCTGAGCGCCGAAAGGGTGAGGGGCGACAATAAAGAGTA<br>CGAGTATTCCGTGGAGTGCCAGGAGGACAGCGCCTGTCCCGCCGCCGAGGAGTCCC<br>TGCCTATCGAGGTGATGGTCGACGCGGTGCACAAGCTCAAGTACGAAAACTACACC<br>AGCAGCTTTTTCATCAGGGATATCATCAAACCAGACCCCCCCAAGAACCTGCAGCT<br>GAAGCCCCTGAAAAACAGCAGGCAGGTGGAAGTGAGCTGGGAATACCCCGATACCT<br>GGTCCACCCCCCACAGCTACTTCAGCCTGACCTTCTGCGTGCAGGTGCAGGGGAAG<br>TCCAAGCGGGAGAAGAAAGATCGGGTGTTCACGGACAAGACCAGCGCCACCGTGAT<br>TTGCAGGAAAAACGCCAGCATCTCCGTGAGGGCTCAGGACAGGTACTACAGCTCCA<br>GCTGGAGCGAGTGGGCCTCCGTGCCTTGCAGCGGGGAGGAGGCGGCGGCAGCAGG<br>AATCTGCCCGTCGCAACCCCCGACCCCGGCATGTTCCCCTGCCTGCACCACAGCCA<br>GAATCTGCTGCGAGCCGTGAGCAACATGCTCCAGAAGGCCCGGCAGACGCTGGAGT<br>CTTACCCCTGCACCTCCGAGGAGATCGACCACGAGGACATCACCAAGGATAAGACG<br>AGCACCGTCGAGGCCTGTCTCCCCCTGGAGCTCACCAAGAACGAGTCCTGCCTGAA<br>TAGCAGGGAGACGTCCTTCATAACCAACGGCAGCTGTCTGGCGTCCAGGAAGACCA<br>GCTTCATGATGGCCCTCTGCCTGAGCTCCATCTACGAGGACCTCAAGATGTACCAG<br>GTCGAGTTCAAGACCATGAACGCAAACTGCTCATGGATCCAAAGAGGCAGATCTT<br>TCTGGACCAGAACATGCTGGCCGTGATCGATGAACTCATGCAGGCCCTGAATTTCA<br>ATTCCGAGACCGTGCCCCAGAAGAGCTCCCTGGAGGAACCCGACTTCTACAAAACA<br>AAGATCAAGCTGTGTATCCTCCTGCACGCCTTCCGGATCAGGGCCGTCACCATTGA<br>CCGGGTGATGTCCTACCTGAACGCCAGC |
| 44 | hIL12AB_040 ORF | ATGTGCCATCAGCAGCTGGTGATCAGCTGGTTCAGCCTCGTGTTCCTCGCCAGCCC<br>CCTCGTGGCCATCTGGGAGCTGAAAAAGGACGTGTACGTGGTGGAGCTGGACTGGT<br>ATCCCGACGCCCCGGGCGAGATGGTGGTGCTGACCTGCGACACCCCCGAGGAGGAC<br>GGCATTACCTGGACACTGGACCAGAGCAGCGAGGTCCTGGGCAGCGGGAAGACCCT<br>GACAATTCAGGTGAAGGAGTTCGGCGACGCCGGACAGTACACGTGCCACAAGGGGG<br>GGGAGGTGCTGTCCCACAGCCTCCTCCTGCTGCACAAGAAGGAGGATGGCATCTGG<br>AGCACCGACATCCTGAAGGATCAGAAGGAGCCCAAGAACAAGACCTTTCTGAGATG<br>CGAGGCCAAGAATTACAGCGGCCGTTTCACCTGCTGGTGGCTCACCACCATCAGCA<br>CCGACCTGACCTTCAGCGTGAAATCCTCCAGGGGCTCCTCCGACCCGCAGGGAGTG<br>ACCTGCGGCGCCGCCACACTGAGCGCCGAGCGGGTCAGAGGGGACAACAAGGAGTA<br>CGAGTACAGCGTTGAGTGCCAGGAGGACAGCGCCTGTCCCGCGGCCGAGGAATCCC<br>TGCCCATCGAGGTGATGGTGGACGCAGTGCACAAGCTGAAGTACGAGAACTATACC<br>TCGAGCTTCTTCATCCGGGATATCATTAAGCCCGATCCCCCGAAGAACCTGCAGCT |

SUMMARY OF SEQUENCES

| SEQ ID NO | Description | Sequence |
|---|---|---|
| | | CAAACCCCTGAAGAACAGCAGGCAGGTGGAGGTCTCCTGGGAGTACCCCGACACAT<br>GGTCCACCCCCATTCCTATTTCTCCCTGACCTTTTGCGTGCAGGTGCAGGGCAAG<br>AGCAAGAGGGAGAAAAAGGACAGGGTGTTCACCGACAAGACCTCCGCCACCGTGAT<br>CTGCCGTAAGAACGCTAGCATCAGCGTCAGGGCCCAGGACAGGTACTATAGCAGCT<br>CCTGGTCCGAGTGGGCCAGCGTCCCGTGCAGCGGCGGGGGCGGTGGAGGCTCCCGG<br>AACCTCCCCGTGGCCACCCCGGACCCCGGGATGTTTCCCTGCCTGCATCACAGCCA<br>GAACCTGCTGAGGGCCGTGTCCAACATGCTGCAGAAGGCCAGGCAGACACTCGAGT<br>TTTACCCCTGCACCAGCGAGGAGATCGACCACGAAGACATCACCAAGGACAAGACC<br>TCCACCGTGGAGGCATGCCTGCCCCTGGAGCTGACCAAAAACGAAAGCTGTCTGAA<br>CTCCAGGGAGACCTCCTTTATCACGAACGGCTCATGCCTGGCCTCCAGAAAGACCA<br>GCTTCATGATGGCCCTGTGCCTGAGCTCCATCTACGAGGACTTGAAAATGTACCAG<br>GTCGAGTTCAAGACCATGAACGCCAAGCTGCTCATGGACCCCAAAAGGCAGGATCTT<br>TCTGGACCAGAATATGCTGGCCGTGATCGACGAGCTCATGCAAGCCCTGAATTTCA<br>ACAGCGAGACCGTGCCCCAGAAGTCCTCCCTGGAGGAGCCCGACTTCTACAAGACC<br>AAGATCAAGCTGTGCATACTCCTGCACGCGTTTAGGATCAGGGCGGTGACCATCGA<br>TAGGGTGATGAGCTACCTGAATGCCTCC |
| 45 | Wild Type IL12B signal peptide Amino acids | MCHQQLVISWFSLVFLASPLVA |
| 46 | Wild Type IL12B signal peptide Nucleic acids | ATGTGTCACCAGCAGTTGGTCATCTCTTGGTTTTCCCTGGTTTTTCTGGCATCTCC<br>CCTCGTGGCC |
| 47 | Syn 5 promoter | ATTGGGCACCCGTAAGGG |
| 48 | Signal peptide-IL12B-linker-IL12A amino acid sequence #1 | MCHQQLVISWFSLVFLASPLVAIWELKKDVYVVELDWYPDAPGEMVVLTCDTPEED<br>GITWTLDQSSEVLGSGKTLTIQVKEFGDAGQYTCHKGGEVLSHSLLLLHKKEDGIW<br>STDILKDQKEPKNKTFLRCEAKNYSGRFTCWWLTTISTDLTFSVKSSRGSSDPQGV<br>TCGAATLSAERVRGDNKEYEYSVECQEDSACPAAEESLPIEVMVDAVHKLKYENYT<br>SSFFIRDIIKPDPPKNLQLKPLKNSRQVEVSWEYPDTWSTPHSYFSLTFCVQVQGK<br>SKREKKDRVFTDKTSATVICRKNASISVRAQDRYYSSSWSEWASVPCSGGGGGGSR<br>NLPVATPDPGMFPCLHHSQNLLRAVSNMLQKARQTLEFYPCTSEEIDHEDITKDKT<br>STVEACLPLELTKNESCLNSRETSFITNGSCLASRKTSFMMALCLSSIYEDLKMYQ<br>VEFKTMNAKLLMDPKRQIFLDQNMLAVIDELMQALNFNSETVPQKSSLEEPDFYKT<br>KIKLCILLHAFRIRAVTIDRVMSYLNAS |
| 49 | Signal peptide-IL12B-linker-IL12A amino acid sequence #2 | MGCHQQLVISWFSLVFLASPLVAIWELKKDVYVVELDWYPDAPGEMVVLTCDTPEE<br>DGITWTLDQSSEVLGSGKTLTIQVKEFGDAGQYTCHKGGEVLSHSLLLLHKKEDGI<br>WSTDILKDQKEPKNKTFLRCEAKNYSGRFTCWWLTTISTDLTFSVKSSRGSSDPQG<br>VTCGAATLSAERVRGDNKEYEYSVECQEDSACPAAEESLPIEVMVDAVHKLKYENY<br>TSSFFIRDIIKPDPPKNLQLKPLKNSRQVEVSWEYPDTWSTPHSYFSLTFCVQVQG<br>KSKREKKDRVFTDKTSATVICRKNASISVRAQDRYYSSSWSEWASVPCSGGGGGGS<br>RNLPVATPDPGMFPCLHHSQNLLRAVSNMLQKARQTLEFYPCTSEEIDHEDITKDK<br>TSTVEACLPLELTKNESCLNSRETSFITNGSCLASRKTSFMMALCLSSIYEDLKMY<br>QVEFKTMNAKLLMDPKRQIFLDQNMLAVIDELMQALNFNSETVPQKSSLEEPDFYK<br>TKIKLCILLHAFRIRAVTIDRVMSYLNAS |
| 50 | miR-122 | CCUUAGCAGAGCUGUGGAGUGUGACAAUGGUGUUUGUGUCUAAACUAUCAAACGCC<br>AUUAUCACACUAAAUAGCUACUGCUAGGC |
| 51 | miR-122-3p | AACGCCAUUAUCACACUAAAUA |
| 52 | miR-122-3p binding site | UAUUUAGUGUGAUAAUGGCGUU |
| 53 | miR-122-5p | UGGAGUGUGACAAUGGUGUUUG |
| 54 | miR-122-5p binding site | CAAACACCAUUGUCACACUCCA |
| 55 | 5'UTR-017 | GGGAAAUAAGAGAGAAAAGAAGAGUAAGAAGAAAUUUAAGAGCCACC |
| 56 | 5'UTR-018 | UCAAGCUUUUGGACCCUCGUACAGAAGCUAAUACGACUCACUAUAGGGAAAUAAGA<br>GAGAAAAGAAGAGUAAGAAGAAAUAUAAGAGCCACC |
| 57 | 142-3p 5'UTR-001 | UGAUAAUGUCCAUAAAGUAGGAAACACUACAGCUGGAGCCUCGGUGGCCAUGCUU<br>CUUGCCCCUUGGGCCUCCCCCAGCCCCUCCUCCCCUUCCUGCACCCGUACCCCCG<br>UGGUCUUUGAAUAAAGUCUGAGUGGGCGGC |

| SEQ ID NO | Description | Sequence |
|---|---|---|
| 58 | 142-3p 5'UTR-002 | UGAUAAUAGGCUGGAGCCUCGGUGGCUCCAUAAAGUAGGAAACACUACACAUGCUU CUUGCCCCUUGGGCCUCCCCCCAGCCCCUCCUCCCCUUCCUGCACCCGUACCCCCG UGGUCUUUGAAUAAAGUCUGAGUGGGCGGC |
| 59 | 142-3p 5'UTR-003 | UGAUAAUAGGCUGGAGCCUCGGUGGCCAUGCUUCUUGCCCCUUCCAUAAAGUAGGA AACACUACAUGGGCCUCCCCCCAGCCCCUCCUCCCCUUCCUGCACCCGUACCCCCG UGGUCUUUGAAUAAAGUCUGAGUGGGCGGC |
| 60 | 142-3p 5'UTR-004 | UGAUAAUAGGCUGGAGCCUCGGUGGCCAUGCUUCUUGCCCCUUGGGCCUCCCCCCA GUCCAUAAAGUAGGAAACACUACACCCCUCCUCCCCUUCCUGCACCCGUACCCCCG UGGUCUUUGAAUAAAGUCUGAGUGGGCGGC |
| 61 | 142-3p 5'UTR-005 | UGAUAAUAGGCUGGAGCCUCGGUGGCCAUGCUUCUUGCCCCUUGGGCCUCCCCCCA GCCCCUCCUCCCCUUCUCCAUAAAGUAGGAAACACUACACUGCACCCGUACCCCCG UGGUCUUUGAAUAAAGUCUGAGUGGGCGGC |
| 62 | 142-3p 5'UTR-006 | UGAUAAUAGGCUGGAGCCUCGGUGGCCAUGCUUCUUGCCCCUUGGGCCUCCCCCCA GCCCCUCCUCCCCUUCCUGCACCCGUACCCCCUCCAUAAAGUAGGAAACACUACAG UGGUCUUUGAAUAAAGUCUGAGUGGGCGGC |
| 63 | 142-3p 5'UTR-007 | UGAUAAUAGGCUGGAGCCUCGGUGGCCAUGCUUCUUGCCCCUUGGGCCUCCCCCCA GCCCCUCCUCCCCUUCCUGCACCCGUACCCCCGUGGUCUUUGAAUAAAGUUCCAUA AAGUAGGAAACACUACACUGAGUGGGCGGC |
| 64 | 3'UTR-001 (Creatine Kinase UTR) | GCGCCUGCCCACCUGCCACCGACUGCUGGAACCCAGCCAGUGGGAGGGCCUGGCCC ACCAGAGUCCUGCUCCCUCACUCCUCGCCCCGCCCCCUGUCCCAGAGUCCCACCUG GGGGCUCUCUCCACCCUUCUCAGAGUUCCAGUUUCAACCAGAGUUCCAACCAAUGG GCUCCAUCCUCUGGAUUCUGGCCAAUGAAAUAUCUCCCUGGCAGGGUCCUCUUCGU UUCCCAGAGCUCCACCCCAACCAGGAGCUCUAGUUAAUGGAGAGCUCCCAGCACAC UCGGAGCUUGUGCUUUGUCUCCACGCAAAGCGAUAAAUAAAAGCAUUGGUGGCCUU UGGUCUUUGAAUAAAGCCUGAGUAGGAAGUCUAGA |
| 65 | 3'UTR-002 (Myoglobin UTR) | GCCCCUGCCGCUCCCACCCCCACCCAUCUGGGCCCCGGGUUCAAGAGAGAGCGGGG UCUGAUCUCGUGUAGCCAUAUAGAGUUUGCUUCUGAGUGUCUGCUUUGUUUAGUAG AGGUGGGCAGGAGGAGCUGAGGGGCUGGGGCUGGGGUGUUGAAGUUGGCUUUGCAU GCCCAGCGAUGCGCCUCCCUGUGGGAUGUCAUCACCCUGGGAACCGGGAGUGGCCC UUGGCUCACUGUGUUCUGCAUGGUUUGGAUCUGAAUUAAUUGUCCUUUCUUCUAAA UCCCAACCGAACUUCUUCCAACCUCCAAACUGGCUGUAACCCCAAAUCCAAGCCAU UAACUACACCUGACAGUAGCAAUUGUCUGAUUAAUCACUGGCCCCUUGAAGACAGC AGAAUGUCCCUUUGCAAUGAGGAGGAGAUCUGGGCUGGGCGGGCCAGCUGGGGAAG CAUUUGACUAUCUGGAACUUGUGUGUGCCUCCUCAGGUAUGGCAGUGACUCACCUG GUUUUAAUAAAACAACCUGCAACAUCUCAUGGUCUUUGAAUAAAGCCUGAGUAGGA AGUCUAGA |
| 66 | 3'UTR-003 (α-actin UTR) | ACACACUCCACCUCCAGCACGCGACUUCUCAGGACGACGAAUCUUCUCAAUGGGGG GGCGGCUGAGCUCCAGCCACCCCGCAGUCACUUUCUUUGUAACAACUUCCGUUGCU GCCAUCGUAAACUGACACAGUGUUUAUAACGUGUACAUACAUUAACUUAUUACCUC AUUUUGUUAUUUUUCGAAACAAAGCCCUGUGGAAGAAAAUGGAAAACUUGAAGAAG CAUUAAAGUCAUUCUGUUAAGCUGCGUAAAUGGUCUUUGAAUAAAGCCUGAGUAGG AAGUCUAGA |
| 67 | 3'UTR-004 (Albumin UTR) | CAUCACAUUUAAAAGCAUCUCAGCCUACCAUGAGAAUAAGAGAAAGAAAAUGAAGA UCAAAAGCUUAUUCAUCUGUUUUUCUUUUUCGUUGGUGUAAAGCCAACACCCUGUC UAAAAAACAUAAAUUUCUUUAAUCAUUUUGCCUCUUUUCUCUGUGCUUCAAUUAAU AAAAAAUGGAAAGAAUCUAAUAGAGUGGUACAGCACUGUUAUUUUUCAAAGAUGUG UUGCUAUCCUGAAAAUUCUGUAGGUUCUGUGGAAGUUCCAGUGUUCUCUCUUAUUC CACUUCGGUAGAGGAUUUCUAGUUUCUUGUGGGCUAAUUAAAUAAAUCAUUAAUAC UCUUCUAAUGGUCUUUGAAUAAAGCCUGAGUAGGAAGUCUAGA |
| 68 | 3'UTR-005 (α-globin UTR) | GCUGCCUUCUGCGGGGCUUGCCUUCUGGCCAUGCCCUUCUUCUCUCCCUUGCACCU GUACCUCUUGGUCUUUGAAUAAAGCCUGAGUAGGAAGGCGGCCGCUCGAGCAUGCA UCUAGA |
| 69 | 3'UTR-006 (G-CSF UTR) | GCCAAGCCCUCCCCAUCCCAUGUAUUUAUCUCUAUUUAAUAUUUAUGUCUAUUUAA GCCUCAUAUUUAAAGACAGGGAAGAGCAGAACGGAGCCCCAGGCCUCUGUGUCCUU CCCUGCAUUUCUGAGUUUCAUUCUCCUGCCUGUAGCAGUGAGAAAAAGCUCCUGUC CUCCCAUCCCUGGACUGGGAGGUAGAUAGGUAAAUACCAAGUAUUUAUUACUAUG ACUGCUCCCCAGCCCUGGCUCUGCAAUGGGCACUGGGAUGAGCCGCUGUGAGCCCC UGGUCCUGAGGGUCCCCACCUGGGACCCUUGAGAGUAUCAGGUCUCCCACGUGGGA GACAAGAAAUCCCUGUUUAAUAUUUAAACAGCAGUGUUCCCCAUCUGGGUCCUUGC ACCCCCACUCUGGCCUCAGCCGACUGCACAGCGGCCCCGCAUCCCCUUGGCUGU GAGGCCCCUGGACAAGCAGAGGUGGCCAGAGCUGGGAGGCAUGGCCCUGGGGUCCC ACGAAUUUGCUGGGGAAUCUCGUUUUUCUUCUUAAGACUUUUGGGACAUGGUUUGA |

| SEQ ID NO | Description | Sequence |
|---|---|---|
| | | CUCCCGAACAUCACCGACGCGUCUCCUGUUUUUCUGGGUGGCCUCGGGACACCUGC CCUGCCCCCACGAGGGUCAGGACUGUGACUCUUUUUAGGGCCAGGCAGGUGCCUGG ACAUUUGCCUUGCUGGACGGGGACUGGGGAUGUGGGAGGGAGCAGACAGGAGGAAU CAUGUCAGGCCUGUGUGUGAAAGGAAGCUCCACUGUCACCCUCCACCUCUUCACCC CCCACUCACCAGUGUCCCCUCCACUGUCACAUUGUAACUGAACUUCAGGAUAAUAA AGUGUUUGCCUCCAUGGUCUUUGAAUAAAGCCUGAGUAGGAAGGCGGCCGCUCGAG CAUGCAUCUAGA |
| 70 | 3'UTR-007 (Col1a2; collagen, Type I, alpha 2 UTR) | ACUCAAUCUAAAUUAAAAAGAAAGAAAUUUGAAAAAACUUUCUCUUUGCCAUUUC UUCUUCUUCUUUUUUAACUGAAAGCUGAAUCCUUCCAUUUCUUCUGCACAUCUACU UGCUUAAAUUGUGGGCAAAAGAGAAAAAGAAGGAUUGAUCAGAGCAUUGUGCAAUA CAGUUUCAUUAACUCCUUCCCCCGCUCCCCCAAAAAUUUGAAUUUUUUUUCAACA CUCUUACACCUGUAUGGAAAAUGUCAACCUUUGUAAGAAAACCAAAAUAAAAAUU GAAAAAUAAAAACCAUAAACAUUUGCACCACUUGUGGCUUUUGAAUAUCUUCCACA GAGGGAAGUUUAAAACCCAAACUUCCAAAGGUUUAAACUACCUCAAAACACUUUCC CAUGAGUGUGAUCCACAUUGUUAGGUGCUGACCUAGACAGAGAUGAACUGAGGUCC UUGUUUUGUUUUGUUCAUAAUACAAAGGUGCUAAUUAAUAGUAUUUCAGAUACUUG AAGAAUGUUGAUGGUGCUAGAAGAAUUUGAGAAGAAAUACUCCUGUAUUGAGUUGU AUCGUGUGGUGUAUUUUUUAAAAAAUUUGAUUUAGCAUUCAUAUUUUCCAUCUUAU UCCCAAUUAAAAGUAUGCAGAUUAUUUGCCCAAAUCUUCUUCAGAAUCUCAGCAUUUG UUCUUUGCCAGUCUCAUUUUCAUCUUCUUCCAUGGUUCCACAGAAGCUUUGUUUCU UGGGCAAGCAGAAAAAAUUAAAUUGUACCUAUUUUGUAUAUGUGAGAUGUUUAAAUA AAUUGUGAAAAAAUGAAAUAAAGCAUGUUUGGUUUUCCAAAAGAACAUAU |
| 71 | 3'UTR-008 (Col6a2; collagen, Type VI, alpha 2 UTR) | CGCCGCCGCCCGGGCCCCGCAGUCGAGGGUCGUGAGCCCACCCCGUCCAUGGUGCU AAGCGGGCCCGGGUCCCACACGGCCAGCACCGCUGCUCACUCGGACGACGCCCUGG GCCUGCACCUCUCCAGCUCCUCCCACGGGGUCCCCGUAGCCCCGGCCCCCGCCCAG CCCCAGGUCUCCCCAGGCCCUCCCGCAGGCUGCCCGGCCUCCCUCCCCCUGCAGCCA UCCCAAGGCUCCUGACCUACCUGGCCCCUGAGCUCUGGAGCAAGCCCUGACCCAAU AAAGGCUUUGAACCCAU |
| 72 | 3'UTR-009 (RPN1; ribophorin I UTR) | GGGGCUAGAGCCCUCUCCGCACAGCUGGGAGACGGGGCAAGGAGGGGGGUUAUUAG GAUUGGUGGUUUUGUUUUGCUUUGUUUAAAGCCGUGGGAAAAUGGCACAACUUUAC CUCUGUGGGAGAUGCAACACUGAGAGCCAAGGGUGGGAGUUGGGAUAAUUUUUAU AUAAAAGAAGUUUUUCCACUUUGAAUUGCUAAAAGUGGCAUUUUUCCUAUGUGCAG UCACUCCUCUCAUUUCUAAAAUAGGGACUGGGCCAGGCACGGUGGCUCAUGCCUGU AAUCCCAGCACUUUGGGAGGCCGAGGCAGGCGGCUCACGAGGUCAGGAGAUCGAGA CUAUCCUGGCUAACACGGUAAAACCCUGUCUCUACUAAAAGUACAAAAAAUUAGCU GGGCGUGGUGGUGGGCACCUGUAGUCCCAGCUACUCGGGAGGCUGAGGCAGGAGAA AGGCAUGAAUCCAAGAGGCAGAGCUUGCAGUGAGCUGAGAUCACGCCAUUGCACUC CAGCCUGGGCAACAGUGUUAAGACUCUGUCUCAAAUAUAAAUAAAUAAAUAAAUAA AUAAAUAAAUAAAUAAAAAAUAAAGCGAGAUGUUGCCCUCAA |
| 73 | 3'UTR-010 (LRP1; low density lipoprotein receptor-related protein 1 UTR) | GGCCCUGCCCCGUCGGACUGCCCCCAGAAAGCCUCCUGCCCCCUGCCAGUGAAGUC CUUCAGUGAGCCCCUCCCCAGCCAGCCCUUCCCUGGCCCCGCCGGAUGUAUAAAUG UAAAAAUGAAGGAAUUACAUUUUAUAUGUGAGCGAGCAAGCCGGCAAGCGAGCACA GUAUUAUUUCUCCAUCCCCUCCCUGCCUGCUCCUUUGGCACCCCCAUGCUGCCUUCA GGGAGACAGGCAGGGAGGGCUUGGGGCUGCACCUCCUACCCUCCCACCAGAACGCA CCCCACUGGGAGAGCUGGUGGUGCAGCCUUCCCUCCCUGUAUAAGACACUUUGCC AAGGCUCUCCCCUCUCGCCCCAUCCCUGCUUGCCCGCUCCCACAGCUUCCUGAGGG CUAUUCUGGGAAGGGAGAGUUCUUUGCUGCCCCUGUCUGGAAGACGUGGCUCUGG GUGAGGUAGGCGGGAAAGGAUGGAGUGUUUUAGUUCUUGGGGGAGGCCACCCCAAA CCCCAGCCCCAACUCCAGGGGCACCUAUGAGAUGGCCAUGCUCAACCCCCCUCCCA GACAGGCCCUCCCUGUCUCCAGGGCCCCCACCGAGGUUCCAGGGCUGGAGACUUC CUCUGGUAAACAUUCCUCCAGCCUCCCCUCCCCUGGGGACGCCAAGGAGGUGGGCC ACACCCAGGAAGGGAAAGCGGGCAGCCCCGUUUGGGGACGUGAACGUUUUAAUAA UUUUUGCUGAAUUCCUUUACAACUAAAUAACACAGAUAUUGUUAUAAAUAAAAUUGU |
| 74 | 3'UTR-011 (Nnt1; cardiotrophin-like cytokine factor 1 UTR) | AUAUUAAGGAUCAAGCUGUUAGCUAAUAAUGCCACCUCUGCAGUUUUGGGAACAGG CAAAUAAAGUAUCAGUAUACAUGGUGAUGUACAUCUGUAGCAAAGCUCUUGGAGAA AAUGAACACUGAAGAAAGCAAAGCAAAAUGUAAUAGAGAGAUUUUUCAAAAGCAG UAAUCCCUCAAUUUUAAAAAGGAUGAAAAUUCUAAAUGUCUUUCUGUGCAUAUU UUUUGUGUUAGGAAUCAAAAGUAUUUUAUAAAAGGAGAAAGAACAGCCUCAUUUUA GAUGUAGUCCUGUUGGAUUUUUAUGCCUCCUCAGUAACCAGAAAUGUUUUAAAAA ACUAAGUGUUUAGGAUUUCAAGACAACAUUAUACAUGGCUCUGAAAUAUCUGACAC AAUGUAAACAUUGCAGGCACCUGCAUUUUAUGUUUUUUUUUCAACAAAUGUGACU AAUUUGAAACUUUUAUGAACUUCUGAGCUGUCCCCUUGCAAUUCAACCGCAGUUUG UAAUAAUCAUAUCAAAUCAGUUUUAAUUUUUUAAAUUGUACUUCAGAGUCUAUAUU UCAGGGCACAUUUUCUCACUACUAUUUUAAUACAUUAAAGGACUAAAUAAUCUUU CAGAGAUGCUGGAAACAAAUCAUUUGCUUUAUAUGUUUCAUUAGAAUACCAAUGAA ACAUACAACUUGAAAAUUAGUAAUAGUAUUUUGAAGAUCCCAUUUCUAAUUGGAG AUCUCUUUAAUUUCGAUCAACUUAUAAUGUGUAGUACUAUAUUAAGUGCACUUGAG |

| SEQ ID NO | Description | Sequence |
|---|---|---|
| | | UGGAAUUCAACAUUUGACUAAUAAAAUGAGUUCAUCAUGUUGGCAAGUGAUGUGGC<br>AAUUAUCUCUGGUGACAAAAGAGUAAAAUCAAAUAUUUCUGCCUGUUACAAAUAUC<br>AAGGAAGACCUGCUACUAUGAAAUAGAUGACAUUAAAUCUGUCUUCACUGUUUAUAA<br>UACGGAUGGAUUUUUUUUCAAAUCAGUGUGUGUUUUGAGGUCUUUAUGUAAUUGAUG<br>ACAUUUGAGAGAAAUGGUGGCUUUUUUUAGCUACCUCUUUGUUCAUUUAAGCACCA<br>GUAAAGAUCAUGUCUUUUUAUAGAAGUGUAGAUUUUCUUUGUGACUUUGCUAUCGU<br>GCCUAAAGCUCUAAAUAUAGGUGAAUGUGUGAUGAAUACUCAGAUUAUUUGUCUCU<br>CUAUAUAAUUAGUUUGGUACUAAGUUUCUCAAAAAAUUAUUAACACAUGAAAGACA<br>AUCUCUAAACCAGAAAAAGAAGUAGUACAAAUUUUGUUACUGUAAUGCUCGCGUUU<br>AGUGAGUUUAAAACACACAGUAUCUUUUGGUUUUAUAAUCAGUUUCUAUUUGCUG<br>UGCCUGAGAUUAAGAUCUGUGUAUGUGUGUGUGUGUGUGCGUUUGUGUGUUA<br>AAGCAGAAAAGACUUUUUUAAAAGUUUUAAGUGAUAAAUGCAAUUUGUUAAUUGAU<br>CUUAGAUCACUAGUAAACUCAGGGCUGAAUUAUACCAUGUAUAUUCUAUUAGAAGA<br>AAGUAAACACCAUCUUUAUUCCUGCCCUUUUUCUUCUCUCAAAGUAGUUGUAGUUA<br>UAUCUAGAAAGAAGCAAUUUUGAUUUCUUGAAAAGGUAGUUCCUGCACUCAGUUUA<br>AACUAAAAAUAAUCAUCUUGGAUUUAUUUAUUUUUGUCAUAGUAAAAAUUUUAA<br>UUUUAUAUAUAUUUUUAUUUAGUAUUAUCUUAUUCUUUGCUAUUUGCCAAUCCUUUG<br>UCAUCAAUUGUGUUAAAUGAAUUGAAAAUUCAUGCCCUGUUCAUUUUAUUUUACUU<br>UAUUGGUUAGGAUAUUUAAAGGAUUUUGUAUAUAUAAUUUCUUAAAUUAAUAUUC<br>CAAAAGGUUAGUGGACUUUAGAUUAUAAAUUAUGGCAAAAAUCUAAAAACAACAAAA<br>AUGAUUUUUAUACAUUCUAUUUCAUUAUUCCUCUUUUUCCAAUAAGUCAUACAAUU<br>GGUAGAUAUGACUAUUUUAUUUUUGUAUAAUUCACUAUAUCUUUAUGAUAUUUAA<br>GUAUAAAUAAUUAAAAAAAUUUAAUUGUACCUUAUAGUCUGUCACCAAAAAAAAAAA<br>AUUAUCUGUAGGUAGUGAAAUGCUAAUGUUGAUUUGUCUUUAAGGGCUUGUUAACU<br>AUCCUUUAUUUUCUCAUUUGUCUUAAAUUAGGAGUUUGUGUUUAAAUUACUCAUCU<br>AAGCAAAAAAGUGUAUAUAAAUCCCAUUACUGGGUAUAUACCCAAAGGAUUAUAAAU<br>CAUGCUGCUAUAAAGACACAUGCACACGUAUGUUUAUUGCAGCACUAUUCACAAUA<br>GCAAAGACUUGGAACCAACCCAAAUGUCCAUCAAUGAUGACUUGAUUAAGAAAAU<br>GUGCACAUAUACACCAUGGAAUACUAUGCAGCCAUAAAAAAGGAUGAGUUCAUGUC<br>CUUUGUAGGGACAUGGAUAAAGCUGGAAACCAUCAUUCUGAGCAAACUAUUGCAAG<br>GACAGAAACCAAACACUGCAUGUUCUCACUCAUAGGUGGGAAUUGAACAAUGAGA<br>ACACUUGGACACAAGGUGGGGAACACCACACACCAGGGCCUGUCAUGGGGUGGGG<br>GAGUGGGGAGGGAUAGCAUUAGGAGAUAUACCUAAUGUAAAUGAUGAGUUAAUGGG<br>UGCAGCACACCAACAUGGCACAUGUAUACAUAUGUAGCAAACCUGCACGUUGUGCA<br>CAUGUACCCUAGAACUUAAAGUAUAAUUAAAAAAAAAAAGAAAACAGAAGCUAUUU<br>AUAAAGAAGUUAUUUGCUGAAAUAAAUGUGAUCUUUCCCAUUAAAAAAAUAAAGAA<br>AUUUUGGGUAAAAAAACACAAUAGAUUGUAUUCUUGAAAAAUUCUAAGAGAGUGG<br>AUGUGAAGUGUUCUCACCACAAAAGUGAUAACUAAUUGAGGUAAUGCACAUAUUAA<br>UUAGAAAGAUUUUGUCAUUCCACAAUGUAUAUAUACUUAAAAAUAUGUUAUACACA<br>AUAAAUACAUCAUUAAAAAAUAAGUAAAUGUA |
| 75 | 3'UTR-012 (Col6a1; collagen, Type VI, alpha 1 UTR) | CCCACCCCUGCACGCCGGCACCAAACCCUGUCCUCCCACCCCUCCCCACUCAUCACU<br>AAACAGAGUAAAAUGUGAUGCGAAUUUUCCCGACCAACCUGAUUCGCUAGAUUUUU<br>UUUAAGGAAAAGCUUGGAAAGCCAGGACACAACGCUGCUGCCUGCUUUGUGCAGGG<br>UCCUCCGGGGCUCAGCCCUGAGUUGGCAUCACCUGCGCAGGGCCCUCUGGGGCUCA<br>GCCCUGAGCUAGUGCACCUGCACAGGGCCCUGAGGCUCAGCCCUGAGCUGGCG<br>UCACCUGUGCAGGGCCCUCUGGGGCUCAGCCCUGAGCUGGCCUCACCUGGGUUCCC<br>CACCCCGGGCUCUCCUGCCCUGCCCUCCUGCCCGCCCUCCCUCCUGCCUGCGCAGC<br>UCCUUCCCUAGGCACCUCUGUGCUGCAUCCCACCAGCCUGAGCAAGACGCCCUCUC<br>GGGGCCUGUGCCGCACUAGCCUCCCCUCUCCUCUGUCCCCAUAGCUGGUUUUUCCCA<br>CCAAUCCUCACCUAACAGUUACUUUACAAUUAAACUCAAAGCAAGCUCUUCUCCUC<br>AGCUUGGGGCAGCCAUUGGCCUCUGUCUCGUUUUGGGAAACCAAGGUCAGGAGGCC<br>GUUGCAGACAUAAAUCUCGGCGACUCGGCCCCGUCUCCUGAGGGUCCUGCUGGUGA<br>CCGGCCUGGACCUUGGCCCUACAGCCCUGGAGGCCGCUGCUGACCAGCACUGACCC<br>CGACCUCAGAGAGUACUCGCAGGGGCGCUGGCUGCACUCAAGACCCUCGAGAUUAA<br>CGGUGCUAACCCCGUCUGCUCCUCCCUCCCGCAGAGACUGGGGCCUGGACUGGACA<br>UGAGAGCCCCUUGGUGCCACAGAGGGCUGUGUCUUACUAGAAACAACGCAAACCUC<br>UCCUUCCUCAGAAUAGUGAUGUGUUCGACGUUUAUCAAAGGCCCCCUUUCUAUGU<br>UCAUGUUAGUUUGCUCCUUCUGUGUUUUUUCUGAACCAUAUCCAUGUUGCUGAC<br>UUUUCCAAAUAAAGGUUUUCACUCCUCUC |
| 76 | 3'UTR-013 (Calr; calreticulin UTR) | AGAGGCCUGCCUCCAGGGCUGGACUGAGGCCUGAGCGCUCCUGCCGCAGAGCUGGC<br>CGCGCCAAAUAAUGUCUCUGUGAGACUCGAGAACUUUCAUUUUUUUCCAGGCUGGU<br>UCGGAUUUGGGGUGGAUUUGGUUUUGUUCCCCUCCUCCACUCUCCCCCACCCCCU<br>CCCCGCCCUUUUUUUUUUUUUUUUAAACUGGUAUUUUAUCUUUGAUUCUCCUUC<br>AGCCCUCACCCCUGGUUCUCAUCUUUCUUGAUCAACAUCUUUUCUUGCCUCUGUCC<br>CCUUCUCUCAUCUCUUUAGCUCCCCUCCAACCUGGGGGGCAGUGGUGUGGAGAAGCC<br>ACAGGCCUGAGAUUUCAUCUGCUCUCCUUCCUGGAGCCCAGAGGAGGGCAGCAGAA<br>GGGGGUGGUGUCUCCAACCCCCCAGCACUGAGGAAGAACGGGGCUCUUCUCAUUUC<br>ACCCCUCCCUUUCUCCCCUGCCCCCAGGACUGGGCCACUUCUGGGUGGGGCAGUGG<br>GUCCCAGAUUGGCUCACACUGAGAAUGUAAGAACUACAAACAAAAUUUCUAUUAAA<br>UUAAAUUUUGUGUCUCC |

SUMMARY OF SEQUENCES

| SEQ ID NO | Description | Sequence |
|---|---|---|
| 77 | 3'UTR-014 Col1a1; collagen, Type I, alpha 1 UTR) | CUCCCUCCAUCCCAACCUGGCUCCCUCCCACCCAACCAACUUUCCCCCCAACCCGG AAACAGACAAGCAACCCAAACUGAACCCCCUCAAAAGCCAAAAAAUGGGAGACAAU UUCACAUGGACUUUGGAAAAUAUUUUUUUCCUUUGCAUUCAUCUCUCAAACUUAGU UUUUAUCUUUGACCAACCGAACAUGACCAAAAACCAAAAGUGCAUUCAACCUUACC AAAAAAAAAAAAAAAAAAAGAAUAAAUAAUAACUUUUUAAAAAAGGAAGCUUGGU CCACUUGCUUGAAGACCCAUGCGGGGGUAAGUCCCUUUCUGCCCGUUGGGCUUAUG AAACCCCAAUGCUGCCCUUUCUGCUCCUUUCUCCACACCCCCCUUGGGGCCUCCCC UCCACUCCUUCCCAAAUCUGUCUCCCCAGAAGACACAGGAAACAAUGUAUUGUCUG CCCAGCAAUCAAAGGCAAUGCUCAAACACCCAAGUGGCCCCCACCCUCAGCCCGCU CCUGCCCGCCCAGCACCCCCAGGCCCUGGGGGACCUGGGGUUCUCAGACUGCCAAA GAAGCCUUGCCAUCUGGCGCUCCCAUGGCUCUUGCAACAUCUCCCCUUCGUUUUUG AGGGGGUCAUGCCGGGGGAGCCACCAGCCCCUCACUGGGUUCGGAGGAGAGUCAGG AAGGGCCACGACAAAGCAGAAACAUCGGAUUUGGGGAACGCGUGUCAAUCCCUUGU GCCGCAGGGCUGGGCGGGAGAGACUGUUCUGUUCCUUGUGUAACUGUGUUGCUGAA AGACUACCUCGUUCUUGUCUUGAUGUGUCACCGGGGCAACUGCCUGGGGGCGGGGA UGGGGGCAGGGUGGAAGCGGCUCCCCAUUUUAUACCAAAGGUGCUACAUCUAUGUG AUGGGUGGGUGGGGAGGGAAUCACUGGUGCUAUAGAAAUUGAGAUGCCCCCCCAG GCCAGCAAAUGUUCCUUUUUGUUCAAAGUCUAUUUUUAUUCCUUGAUAUUUUCUUU UUUUUUUUUUUUUUUGUGGAUGGGGACUUGUGAAUUUUUCUAAAGGUGCUAUUU AACAUGGGAGGAGAGCGUGUGCGGCUUCCAGCCCAGCCCGCUGCUCACUUUCCACCC UCUCUCCACCUGCCUCUGGCUUCUCAGGCCUCUGCUCUCCGACCUCUCUCCUCUGA AACCCUCCUCCACAGCUGCAGCCCAUCCUCCCGGCUCCCUCCUAGUCUGUCCUGCG UCCUCUGUCCCCGGGUUUCAGAGACAACUUCCCAAAGCACAAAGCAGUUUUUCCCC CUAGGGGUGGGAGGAAGCAAAAGACUCUGUACCUAUUUUGUAUGUGUAUAAUAAUU UGAGAUGUUUUUAAUUAUUUUUGAUUGCUGGAAUAAAGCAUGUGGAAAUGACCCAA CAUAAUCCGCAGUGGCCUCCUAAUUUCCUUCUUUGGAGUUUGGGGAGGGGUAGACA UGGGGAAGGGGCUUUGGGGUGAUGGGCUUGCCUUCCAUUCCUGCCCUUUCCCUCCC CACUAUUCUCUUCUAGAUCCCUCCAUAACCCCACUCCCCUUUCUCUCACCCUUCUU AUACCGCAAACCUUUCUACUUCCUCUUUCAUUUUCUAUUCUUGCAAUUUCCUUGCA CCUUUUCCAAAUCCUCUUUCUCCCCUGCAAUACCAUACAGGCAAUCCACGUGCACAA CACACACACACUCUUCACAUCUGGGGUUGUCCAAACCUCAUACCCACUCCCCUU CAAGCCCAUCCACUCUCCACCCCCUGGAUGCCCUGCACUUGGUGGCGGUGGGAUGC UCAUGGAUACUGGGAGGGUGAGGGGAGUGGAACCCGUGAGGAGGACCUGGGGGCCU CUCCUUGAACUGACAUGAAGGGUCAUCGGCCUCUGCUCCCUUCUCACCCACGCUG ACCUCCUGCCGAAGGAGCAACGCAACAGGAGAGGGGUCUGCUGAGCCUGGCGAGGG UCUGGGAGGGACCAGGAGGAAGGCGUGCUCCCUGCUCGCUGUCCUGGCCCUGGGGG AGUGAGGGAGACAGACACCUGGGAGAGCUGUGGGGAAGGCACUGCACCGUGCUCU UGGGAAGGAAGGAGACCUGGCCCUGCUCACCACGGACUGGGUGCCUCGACUCCUG AAUCCCCAGAACACAACCCCCCUGGGCUGGGGUGGUCUGGGGAACCAUCGUGCCCC CGCCUCCCGCCUACUCCUUUUUAAGCUU |
| 78 | 3'UTR-015 (Plod1; procollagen-lysine, 2-oxoglutarate 5-dioxygenase 1 UTR) | UUGGCCAGGCCUGACCCUCUUGGACCUUUCUUCUUUGCCGACAACCACUGCCCAGC AGCCUCUGGGACCUCGGGGUCCCAGGGAACCCAGUCCAGCCUCCUGGCUGUUGACU UCCCAUUGCUCUUGGAGCCACCAAUCAAAGAGAUUCAAAGAGAUUCCUGCAGGCCA GAGGCGGAACACACCUUUAUGGCUGGGGCUCUCCGUGGUGUUCUGGACCCAGCCCC UGGAGACACCAUUCACUUUUACUGCUUUGUAGUGACUCGGCUCUCUCCAACCUGUCU UCCUGAAAACCAAGGCCCCCUUCCCCCACCUCUUCCAUGGGGUGAGACUUGAGCA GAACAGGGGCUUCCCCAAGUUGCCCAGAAAGACUGUCUGGGGUGAGAAGCCAUGGCC AGAGCUUCUCCCAGGCACAGGUGUUGCACCAGGGACUUCUGCUUCAAGUUUUGGGG UAAAGACACCUGGAUCAGACUCCAAGGGCUGCCCUGAGUCUGGGACUUCUGCCUCC AUGGCUGGUCAUGAGAGCAAACCGUAGUCCCCUGGAGACAGCGACUCCAGAGAACC UCUUGGGAGACAGAAGAGGCAUCUGUGCACAGCUCGAUCUUCUACUUGCCUGUGGG GAGGGGAGUGACAGGUCCACACACCACAUGGGUCACCCUGUCCUGGAUGCCUCUG AAGAGAGGGACAGACCGUCAGAAACUGGAGAGUUUCUAUUAAAGGUCAUUUAAACC A |
| 79 | 3'UTR-016 (Nucb1; nucleobindin 1 UTR) | UCCUCCGGGACCCCAGCCCUCAGGAUUCCUGAUGCUCCAAGGCGACUGAUGGGCGC UGGAUGAAGUGGCACAGUCAGCUUCCCUGGGGGCUGGUGUCAUGUUGGGCUCCUGG GGCGGGGGCACGGCCUGGCAUUUCACGCAUUGCUGCCACCCCAGGUCCACCUGUCU CCACUUUCACAGCCUCCAAGUCUGUGGCUCUUCCCUUCUGUCCUCCGAGGGGCUUG CCUUCUCUCGUGUCCAGUGAGGUGCUCAGUGAUCGGCUUAACUUAGAGAAGCCCGC CCCCUCCCCUUCUCCGUCUGUCCCAAGAGGGUCUGCUCUGAGCCUGCGUUCCUAGG UGGCUCGGCCUCAGCUGCCUGGGUUGUGGCCGCCCUAGCAUCCUGUAUGCCCACAG CUACUGGAAUCCCCGCUGCUGCUCCGGGCCAAGCUUCUGGUUGAUUAAUGAGGGCA UGGGGUGGUCCCUCAAGACCUUCCCCUACCUUUUGUGGAACCAGUGAUGCCUCAAA GACAGUGUCCCCUCCACAGCUGGGGUGCCAGGGGCAGGGAUCCUCAGUAUGCCGG UGAACCCUGAUACCAGGAGCCUGGGCCUCCCUGAACCCCUGGCUUCUCAGCCAUCUC AUCGCCAGCCUCCUCCUGGACCUCUUGGCCCCAGCCCCUUCCCCACACAGCCCCA GAAGGGUCCCAGAGCUGACCCCACUCCAGGACCUAGGCCCAGCCCCUCAGCCUCAU CUGGAGCCCCUGAAGACCAGUCCCACCCACCUUUCUGGCCUCAUCUGACACUGCUC CGCAUCCUGCUGUGUGUCCUGUUCCAUGUUCCGGUUCCAUCCAAAUACACUUUCUG GAACAAA |

-continued

SUMMARY OF SEQUENCES

| SEQ ID NO | Description | Sequence |
|---|---|---|
| 80 | 3'UTR-017 (α-globin) | GCUGGAGCCUCGGUGGCCAUGCUUCUUGCCCCUUGGGCCUCCCCCCAGCCCCUCCU CCCCUUCCUGCACCCGUACCCCCGUGGUCUUUGAAUAAAGUCUGAGUGGGCGGC |
| 81 | 3'UTR-018 | UGAUAAUAGGCUGGAGCCUCGGUGGCCAUGCUUCUUGCCCCUUGGGCCUCCCCCCA GCCCCUCCUCCCCUUCCUGCACCCGUACCCCCGUGGUCUUUGAAUAAAGUCUGAGU GGGCGGC |
| 82 | 5'UTR-001 | GGGAAAUAAGAGAGAAAAGAAGAGUAAGAAGAAAUAUAAGAGCCACC |
| 83 | 5'UTR-002 | GGGAGAUCAGAGAAAAGAAGAGUAAGAAGAAAUAUAAGAGCCACC |
| 84 | 5'UTR-003 | GGAAUAAAAGUCUCAACACAACAUAUACAAAACAAACGAAUCUCAAGCAAUCAAGC AUUCUACUUCUAUUGCAGCAAUUUAAAUCAUUUCUUUUAAAGCAAAAGCAAUUUUC UGAAAAUUUUCACCAUUUACGAACGAUAGCAAC |
| 85 | 5'UTR-004 | GGAGACAAGCUUGGCAUUCCGGUACUGUUGGUAAAGCCACC |
| 86 | 5'UTR-005 | GGGAGAUCAGAGAAAAGAAGAGUAAGAAGAAAUAUAAGAGCCACC |
| 87 | 5'UTR-006 | GGAAUAAAAGUCUCAACACAACAUAUACAAAACAAACGAAUCUCAAGCAAUCAAGC AUUCUACUUCUAUUGCAGCAAUUUAAAUCAUUUCUUUUAAAGCAAAAGCAAUUUUC UGAAAAUUUUCACCAUUUACGAACGAUAGCAAC |
| 88 | 5'UTR-007 | GGGAGACAAGCUUGGCAUUCCGGUACUGUUGGUAAAGCCACC |
| 89 | 5'UTR-008 | GGGAAUUAACAGAGAAAAGAAGAGUAAGAAGAAAUAUAAGAGCCACC |
| 90 | 5'UTR-009 | GGGAAAUUAGACAGAAAAGAAGAGUAAGAAGAAAUAUAAGAGCCACC |
| 91 | 5'UTR-010 | GGGAAAUAAGAGAGUAAAGAACAGUAAGAAGAAAUAUAAGAGCCACC |
| 92 | 5'UTR-011 | GGGAAAAAGAGAGAAAAGAAGACUAAGAAGAAAUAUAAGAGCCACC |
| 93 | 5'UTR-012 | GGGAAAUAAGAGAGAAAAGAAGAGUAAGAAGAUAUAUAAGAGCCACC |
| 94 | 5'UTR-013 | GGGAAAUAAGAGACAAAACAAGAGUAAGAAGAAAUAUAAGAGCCACC |
| 95 | 5'UTR-014 | GGGAAAUUAGAGAGUAAAGAACAGUAAGUAGAAUUAAAAGAGCCACC |
| 96 | 5'UTR-015 | GGGAAAUAAGAGAGAAUAGAAGAGUAAGAAGAAAUAUAAGAGCCACC |
| 97 | 5'UTR-016 | GGGAAAUAAGAGAGAAAAGAAGAGUAAGAAGAAAAUUAAGAGCCACC |
| 98 | hIL12AB_001 (5'UTR ORF 3'UTR) | TCAAGCTTTTGGACCCTCGTACAGAAGCTAATACGACTCACTATAGGGAAATAAGA GAGAAAAGAAGAGTAAGAAGAAATATAAGAGCCACCATGTGTCACCAGCAGCTGGT CATTAGCTGGTTTAGCCTTGTGTTCCTGGCCTCCCCCCTTGTCGCTATTTGGGAGC TCAAGAAGGACGTGTACGTGGTGGAGTTGGATTGGTACCCAGACGCGCCCGGAGAG ATGGTAGTTCTGACCTGTGATACCCCAGAGGAGGACGGCATCACCTGGACGCTGGA CCAAAGCAGCGAGGTTTTGGGCTCAGGGAAAACGCTGACCATCCAGGTGAAGGAAT TCGGCGACGCCGGGCAGTACACCTGCCATAAGGGAGGAGAGGTGCTGAGCCATTCC CTTCTTCTGCTGCACAAGAAAGAGGACGGCATCTGGTCTACCGACATCCTGAAAGA CCAGAAGGAGCCCAAGAACAAAACCTTCCTGAGGTGCGAGGCCAAGAACTACTCCG GCAGGTTCACTTGTTGGTGGCTGACCACCATCAGTACAGACCTGACTTTTAGTGTA AAAAGCTCCAGAGGCTCGTCCGATCCCCAAGGGGTGACCTGCGGCGCAGCCACTCT GAGCGCTGAGCGCGTGCGCGGTGACAATAAAGAGTACGAGTACAGCGTTGAGTGTC AAGAAGATAGCGCTTGCCCTGCCGCCGAGGAGAGCCTGCCTATCGAGGTGATGGTT GACGCAGTGCACAAGCTTAAGTACGAGAATTACACCAGCTCATTCTTCATTAGAGA TATAATCAAGCCTGACCCACCCAAGAACCTGCAGCTGAAGCCACTGAAAAACTCAC GGCAGGTCGAAGTGAGCTGGGAGTACCCCGACACCTGGAGCACTCCTCATTCCTAT TTCTCTCTTACATTCTGCGTCCAGGTGCAGGGCAAGAGCAAGCGGGAAAAGAAGGA TCGAGTCTTCACCGACAAAACAAGCGCGACCGTGATTTGCAGGAAGAACGCCAGCA TCTCCGTCAGAGCCCAGGATAGATACTATAGTAGCAGCTGGAGCGAGTGGGCAAGC GTGCCCTGTTCCGGCGGCGGGGGCGGGGGCAGCCGAAACTTGCCTGTCGCTACCCC GGACCCTGGAATGTTTCCGTGTCTGCACCACAGCCAGAACCTGCTGAGAGCCGTGT CGAATATGCTCCAGAAGGCCCGGCAGACCCTTGAGTTCTACCCCTGTACCAGCGAA GAGATCGATCATGAAGATATCACGAAAGATAAAACATCCACCGTCGAGGCTTGTCT CCCGCTGGAGCTGACCAAGAACGAGAGCTGTCTGAATAGCCGGGAGACGTCTTTCA TCACGAATGGTAGCTGTCTGGCCAGCAGGAAAACTTCCTTCATGATGGCTCTCTGC CTGAGCTCTATCTATGAAGATCTGAAGATGTATCAGGTGGAGTTTAAAACAATGAA CGCCAAACTCCTGATGGACCCAAAAAGGCAAATCTTTCTGGACCAGAATATGCTGG CCGTGATAGACGAGCTGATGCAGGCACTGAACTTCAACAGCGAGACGGTGCCACAG AAATCCAGCCTGGAGGAGCCTGACTTTTACAAAACTAAGATCAAGCTGTGTATCCT GCTGCACGCCTTTAGAATCCGTGCCGTGACTATCGACAGGGTGATGTCATACCTCA |

| SEQ ID NO | Description | Sequence |
|---|---|---|
| | | ACGCTTCATGATAATAGGCTGGAGCCTCGGTGGCCATGCTTCTTGCCCCTTGGGCC<br>TCCCCCCAGCCCCTCCTCCCCTTCCTGCACCCGTACCCCCCAAACACCATTGTCAC<br>ACTCCAGTGGTCTTTGAATAAAGTCTGAGTGGGCGGC |
| 99 | hIL12AB_002<br>(5'UTR ORF<br>3'UTR) | TCAAGCTTTTGGACCCTCGTACAGAAGCTAATACGACTCACTATAGGGAAATAAGA<br>GAGAAAAGAAGAGTAAGAAGAAATATAAGAGCCACCATGTGCCACCAGCAGCTGGT<br>GATCAGCTGGTTCAGCCTGGTGTTCCTGGCCAGCCCCCTGGTGGCCATCTGGGAGC<br>TGAAGAAGGACGTGTACGTGGTGGAGTTGGATTGGTACCCCGACGCCCCCGGCGAG<br>ATGGTGGTGCTGACCTGCGACACCCCCGAGGAGGACGGCATCACCTGGACCCTGGA<br>CCAGAGCAGCGAGGTGCTGGGCAGCGGCAAGACCCTGACCATCCAGGTGAAGGAGT<br>TCGGCGACGCCGGCCAGTACACCTGCCACAAGGGCGGCGAGGTGCTGAGCCACAGC<br>CTGCTGCTGCTGCACAAGAAGGAGGACGGCATCTGGAGCACCGACATCCTGAAGGA<br>CCAGAAGGAGCCCAAGAACAAGACCTTCCTGAGATGCGAGGCCAAGAACTACAGCG<br>GCAGATTCACCTGCTGGTGGCTGACCACCATCAGCACCGACCTGACCTTCAGCGTG<br>AAGAGCAGCAGAGGCAGCAGCGACCCCCAGGGCGTGACCTGCGGCGCCGCCACCCT<br>GAGCGCCGAGAGAGTGAGAGGCGACAACAAGGAGTACGAGTACAGCGTGGAGTGCC<br>AGGAAGATAGCGCCTGCCCCGCCGCCGAGGAGAGCCTGCCCATCGAGGTGATGGTG<br>GACGCCGTGCACAAGCTGAAGTACGAGAACTACACCAGCAGCTTCTTCATCAGAGA<br>TATCATCAAGCCCGACCCCCCCAAGAACCTGCAGCTGAAGCCCCTGAAGAACAGCC<br>GGCAGGTGGAGGTGAGCTGGGAGTACCCCGACACCTGGAGCACCCCCCACAGCTAC<br>TTCAGCCTGACCTTCTGCGTGCAGGTGCAGGGCAAGAGCAAGAGAGAGAAGAAAGA<br>TAGAGTGTTCACCGACAAGACCAGCGCCACCGTGATCTGCAGAAAGAACGCCAGCA<br>TCAGCGTGAGAGCCCAAGATAGATACTACAGCAGCAGCTGGAGCGAGTGGGCCAGC<br>GTGCCCTGCAGCGGCGGCGGCGGCGGCGGCAGCAGAAACCTGCCCGTGGCCACCCC<br>CGACCCCGGCATGTTCCCCTGCCTGCACCACAGCCAGAACCTGCTGAGAGCCGTGA<br>GCAACATGCTGCAGAAGGCCCGGCAGACCCTGGAGTTCTACCCCTGCACCAGCGAG<br>GAGATCGACCACGAAGATATCACCAAAGATAAGACCAGCACCGTGGAGGCCTGCCT<br>GCCCCTGGAGCTGACCAAGAACGAGAGCTGCCTGAACAGCAGAGAGACCAGCTTCA<br>TCACCAACGGCAGCTGCCTGGCCAGCAGAAAGACCAGCTTCATGATGGCCCTGTGC<br>CTGAGCAGCATCTACGAGGACCTGAAGATGTACCAGGTGGAGTTCAAGACCATGAA<br>CGCCAAGCTGCTGATGGACCCCAAGCGGCAGATCTTCCTGGACCAGAACATGCTGG<br>CCGTGATCGACGAGCTGATGCAGGCCCTGAACTTCAACAGCGAGACCGTGCCCCAG<br>AAGAGCAGCCTGGAGGAGCCCGACTTCTACAAGACCAAGATCAAGCTGTGCATCCT<br>GCTGCACGCCTTCAGAATCAGAGCCGTGACCATCGACAGAGTGATGAGCTACCTGA<br>ACGCCAGCTGATAATAGGCTGGAGCCTCGGTGGCCATGCTTCTTGCCCCTTGGGCC<br>TCCCCCCAGCCCCTCCTCCCCTTCCTGCACCCGTACCCCCCAAACACCATTGTCAC<br>ACTCCAGTGGTCTTTGAATAAAGTCTGAGTGGGCGGC |
| 100 | hIL12AB_003<br>(5'UTR ORF<br>3'UTR) | TCAAGCTTTTGGACCCTCGTACAGAAGCTAATACGACTCACTATAGGGAAATAAGA<br>GAGAAAAGAAGAGTAAGAAGAAATATAAGAGCCACCATGTGTCACCAGCAGTTGGT<br>CATCTCTTGGTTTTCCCTGGTTTTTCTGGCATCTCCCTCGTGGCCATCTGGGAAC<br>TGAAGAAAGACGTTTACGTTGTAGAATTGGATTGGTATCCGGACGCTCCTGGAGAA<br>ATGGTGGTCCTCACCTGTGACACCCCTGAAGAAGACGGAATCACCTGGACCTTGGA<br>CCAGAGCCAGTGAGGTCTTAGGCTCTGGCAAAACCCTGACCATCCAAGTCAAAGAGT<br>TTGGAGATGCTGGCCAGTACACCTGTCACAAAGGAGGCGAGGTTCTAAGCCATTCG<br>CTCCTGCTGCTTCACAAAAAGGAAGATGGAATTTGGTCCACTGATATTTTAAAGGA<br>CCAGAAAGAACCCAAAAATAAGACCTTTCTAAGATGCGAGGCCAAGAATTATTCTG<br>GACGTTTCACCTGCTGGTGGCTGACGACAATCAGTACTGATTTGACATTCAGTGTC<br>AAAAGCAGCAGAGGCTCTTCTGACCCCCAAGGGGTGACGTGCGGAGCTGCTACACT<br>CTCTGCAGAGAGAGTCAGAGGTGACAACAAGGAGTATGAGTACTCAGTGGAGTGCC<br>AGGAAGATAGTGCCTGCCCAGCTGCTGAGGAGAGTCTGCCCATTGAGGTCATGGTG<br>GATGCCGTTCACAAGCTCAAGTATGAAAACTACACCAGCAGCTTCTTCATCAGAGA<br>TATCATCAAACCTGACCCACCCAAGAACTTGCAGCTGAAGCCATTAAAGAATTCTC<br>GGCAGGTGGAGGTCAGCTGGGAGTACCCTGACACCTGGAGTACTCCACATTCCTAC<br>TTCTCCCTGACATTCTGCGTTCAGGTCCAGGGCAAGAGCAAGAGAGAAAAGAAAGA<br>TAGAGTCTTCACAGATAAGACCTCAGCCACGGTCATCTGCCGCAAAAATGCCAGCA<br>TTAGCGTGCGGGCCCAGGACCGCTACTATAGCTCATCTTGGAGCGAATGGGCATCT<br>GTGCCCTGCAGTGGCGGAGGGGGCGGAGGGAGCAGAAACCTCCCCGTGGCCACTCC<br>AGACCCAGGAATGTTCCCATGCCTTCACCACTCCCAAAACCTGCTGAGGGCCGTCA<br>GCAACATGCTCCAGAAGGCCCGGCAAACTTTAGAATTTTACCCTTGCACTTCTGAA<br>GAGATTGATCATGAAGATATCACAAAAGATAAAACCAGCACAGTGGAGGCCTGTTT<br>ACCATTGGAATTAACCAAGAATGAGAGTTGCCTAAATTCCAGAGAGACCTCTTTCA<br>TAACTAATGGGAGTTGCCTGGCCTCCAGAAAGACCTCTTTTATGATGGCCCTGTGC<br>CTTAGTAGTATTTATGAAGATTTGAAGATGTACCAGGTGGAGTTCAAGACCATGAA<br>TGCAAAGCTTCTGATGGATCCTAAGAGGCAGATCTTTTTAGATCAAAACATGCTGG<br>CAGTTATTGATGAGCTGATGCAGGCCCTGAATTTCAACAGTGAGACGGTGCCACAA<br>AAATCCTCCCTTGAAGAACCAGATTTCTACAAGACCAAGATCAAGCTCTGCATACT<br>TCTTCATGCTTTCAGAATTCGGGCAGTGACTATTGATAGAGTGATGAGCTATCTGA<br>ATGCTTCCTGATAATAGGCTGGAGCCTCGGTGGCCATGCTTCTTGCCCCTTGGGCC<br>TCCCCCCAGCCCCTCCTCCCCTTCCTGCACCCGTACCCCCCAAACACCATTGTCAC<br>ACTCCAGTGGTCTTTGAATAAAGTCTGAGTGGGCGGC |

SUMMARY OF SEQUENCES

| SEQ ID NO | Description | Sequence |
|---|---|---|
| 101 | Human CD8A Transmembrane Domain | IYIWAPLAGTCGVLLLSLVITLYCY |
| 102 | Human PDGF-RB Transmembrane domain | VVVISAILALVVLTIISLIILIMLW |
| 103 | Human CD80 Transmembrane domain | LLPSWAITLISVNGIFVICCL |
| 104 | hIL12AB_004 (5'UTR ORF 3'UTR) | TCAAGCTTTTGGACCCTCGTACAGAAGCTAATACGACTCACTATAGGGAAATAAGA GAGAAAAGAAGAGTAAGAAGAAATATAAGAGCCACCATGGGCTGCCACCAGCAGCT GGTCATCAGCTGGTTCTCCCTGGTCTTCCTGGCCAGCCCCCTGGTGGCCATCTGGG AGCTGAAGAAAGACGTCTACGTAGTAGAGTTGGATTGGTACCCAGACGCACCTGGA GAAATGGTGGTTCTCACCTGTGACACGCCAGAAGAAGACGGTATCACCTGGACGCT GGACCAGAGCTCAGAAGTTCTTGGCAGTGGAAAAACGCTGACCATACAAGTAAAAG AATTTGGGGATGCTGGCCAGTACACCTGCCACAAAGGAGGAGAAGTTCTCAGCCAC AGCCTGCTGCTGCTGCACAAGAAAGAAGATGGCATCTGGAGCACAGATATTTTAAA AGACCAGAAGGAGCCCAAGAACAAAACCTTCCTTCGATGTGAGGCCAAGAACTACA GTGGCCGCTTCACCTGCTGGTGGCTCACCACCATCAGCACAGACCTCACCTTCTCG GTGAAGAGCAGCCGTGGCAGCTCAGACCCCCAAGGAGTCACCTGTGGGGCGGCCAC GCTGTCGGCAGAAAGAGTTCGAGGTGACAACAAGGAATATGAATACTCGGTGGAAT GTCAAGAAGATTCGGCCTGCCCGGCGGCAGAAGAAAGTCTTCCCATAGAAGTCATG GTGGATGCTGTTCACAAATTAAAATATGAAAACTACACCAGCAGCTTCTTCATCAG AGATATCATCAAGCCAGACCCGCCCAAGAACCTGCAGCTGAAGCCCCTGAAGAACA GCCGGCAGGTGGAAGTTTCCTGGGAGTACCCAGATACGTGGAGCACGCCGCACAGC TACTTCAGCCTCACCTTCTGTGTACAAGTACAAGGCAAGAGCAAGAGAGAGAAGAA AGATCGTGTCTTCACAGATAAAACCTCGGCGACGGTCATCTGCAGGAAGAATGCCT CCATCTCGGTTCGAGCCCAGGACCGCTACTACAGCAGCAGCTGGAGTGAGTGGGCC TCGGTGCCCTGCAGTGGTGGCGGCGGCGGCGGCAGCAGAAACCTTCCTGTGGCCAC GCCGGACCCTGGCATGTTCCCGTGCCTGCACCACAGCCAAAATTTACTTCGAGCTG TTTCTAACATGCTGCAGAAAGCACGGCAAACTTTAGAATTCTACCCCTGCACCTCA GAAGAAATAGACCATGAAGATATCACCAAAGATAAAACCAGCACTGTAGAGGCCTG CCTGCCCCTGGAGCTCACCAAGAATGAATCCTGCCTCAACAGCAGAGAGACCAGCT TCATCACCAATGGCAGCTGCCTGGCCAGCAGGAAAACCAGCTTCATGATGGCGCTC TGCCTGAGCAGCATCTATGAAGATTTGAAGATGTACCAAGTAGAATTTAAAACCAT GAATGCCAAGCTGCTCATGGACCCCAAGCGGCAGATATTTTTGGATCAAAACATGC TGGCTGTCATTGATGAGCTCATGCAAGCATTAAACTTCAACTCAGAGACGGTGCCC CAGAAGAGCAGCCTGGAGGAGCCAGATTTCTACAAAACCAAGATCAAGCTCTGCAT CTTATTACATGCCTTCCGCATCCGGGCGGTCACCATTGACCGTGTCATGTCCTACT TAAATGCCAGCTGATAATAGGCTGGAGCCTCGGTGGCCATGCTTCTTGCCCCTTGG GCCTCCCCCAGCCCCTCCTCCCCTTCCTGCACCCGTACCCCCCAAACACCATTGT CACACTCCAGTGGTCTTTGAATAAAGTCTGAGTGGGCGGC |
| 105 | hIL12AB_005 (5'UTR ORF 3'UTR) | TCAAGCTTTTGGACCCTCGTACAGAAGCTAATACGACTCACTATAGGGAAATAAGA GAGAAAAGAAGAGTAAGAAGAAATATAAGAGCCACCATGTGCCACCAGCAGCTGGTT CATCAGCTGGTTCTCCCTGGTCTTCCTGGCCAGCCCCCTGGTGGCCATCTGGGAGC TGAAGAAAGACGTCTACGTAGTAGAGTTGGATTGGTACCCAGACGCACCTGGAGAA ATGGTGGTTCTCACCTGTGACACGCCAGAAGAAGACGGTATCACCTGGACGCTGGA CCAGAGCTCAGAAGTTCTTGGCAGTGGAAAAACGCTGACCATACAAGTAAAAGAAT TTGGGGATGCTGGCCAGTACACCTGCCACAAAGGAGGAGAAGTTCTCAGCCACAGC CTGCTGCTGCTGCACAAGAAAGAAGATGGCATCTGGAGCACAGATATTTTAAAAGA CCAGAAGGAGCCCAAGAACAAAACCTTCCTTCGATGTGAGGCCAAGAACTACAGTG GCCGCTTCACCTGCTGGTGGCTCACCACCATCAGCACAGACCTCACCTTCTCGGTT AAGAGCAGCCGTGGCAGCTCAGACCCCCAAGGAGTCACCTGTGGGGCGGCCACGCT GTCGGCAGAAAGAGTTCGAGGTGACAACAAGGAATATGAATACTCGGTGGAATGTC AAGAAGATTCGGCCTGCCCGGCGGCAGAAGAAAGTCTTCCCATAGAAGTCATGGTG GATGCTGTTCACAAATTAAAATATGAAAACTACACCAGCAGCTTCTTCATCAGAGA TATCATCAAGCCAGACCCGCCCAAGAACCTGCAGCTGAAGCCCCTGAAGAACAGCC GGCAGGTGGAAGTTTCCTGGGAGTACCCAGATACGTGGAGCACGCCGCACAGCTAC TTCAGCCTCACCTTCTGTGTACAAGTACAAGGCAAGAGCAAGAGAGAGAAGAAAGA TCGTGTCTTCACAGATAAAACCTCGGCGACGGTCATCTGCAGGAAGAATGCCTCCA TCTCGGTTCGAGCCCAGGACCGCTACTACAGCAGCAGCTGGAGTGAGTGGGCCTCG GTGCCCTGCAGTGGTGGCGGCGGCGGCGGCAGCAGAAACCTTCCTGTGGCCACGCC GGACCCTGGCATGTTCCCGTGCCTGCACCACAGCCAAAATTTACTTCGAGCTGTTT CTAACATGCTGCAGAAAGCACGGCAAACTTTAGAATTCTACCCCTGCACCTCAGAA GAAATAGACCATGAAGATATCACCAAAGATAAAACCAGCACTGTAGAGGCCTGCCT GCCCCTGGAGCTCACCAAGAATGAATCCTGCCTCAACAGCAGAGAGACCAGCTTCA TCACCAATGGCAGCTGCCTGGCCAGCAGGAAAACCAGCTTCATGATGGCGCTCTGC CTGAGCAGCATCTATGAAGATTTGAAGATGTACCAAGTAGAATTTAAAACCATGAA |

SUMMARY OF SEQUENCES

| SEQ ID NO | Description | Sequence |
|---|---|---|
| | | TGCCAAGCTGCTCATGGACCCCAAGCGGCAGATATTTTTGGATCAAAACATGCTGG<br>CTGTCATTGATGAGCTCATGCAAGCATTAAACTTCAACTCAGAGACGGTGCCCCAG<br>AAGAGCAGCCTGGAGGAGCCAGATTTCTACAAAACCAAGATCAAGCTCTGCATCTT<br>ATTACATGCCTTCCGCATCCGGGCGGTCACCATTGACCGTGTCATGTCCTACTTAA<br>ATGCCAGCTGATAATAGGCTGGAGCCTCGGTGGCCATGCTTCTTGCCCCTTGGGCC<br>TCCCCCCAGCCCCTCCTCCCCTTCCTGCACCCGTACCCCCCAAACACCATTGTCAC<br>ACTCCAGTGGTCTTTGAATAAAGTCTGAGTGGGCGGC |
| 106 | hIL12AB_006<br>(5'UTR ORF<br>3'UTR) | TCAAGCTTTTGGACCCTCGTACAGAAGCTAATACGACTCACTATAGGGAAATAAGA<br>GAGAAAAGAAGAGTAAGAAGAAATATAAGAGCCACCATGTGCCACCAGCAGCTGGT<br>GATCAGCTGGTTCAGCCTGGTTCCTGGCCAGCCCCCTGGTGGCCATCTGGGAGC<br>TGAAGAAGGACGTGTACGTGGTGGAGTTGGATTGGTACCCCGACGCCCCCGGCGAG<br>ATGGTGGTGCTGACCTGTGACACCCCCGAGGAGGACGGCATCACCTGGACCCTGGA<br>CCAGAGCAGCGAGGTGCTGGGCAGCGGCAAGACCCTGACCATCCAGGTGAAGGAGT<br>TCGGGGACGCCGGCCAGTACACCTGCCACAAGGGCGGCGAGGTGCTGAGCCACAGC<br>CTGCTGCTGCTGCACAAGAAGGAGGACGGCATCTGGAGCACAGATATCCTGAAGGA<br>CCAGAAGGAGCCCAAGAACAAGACCTTCCTGAGATGCGAGGCCAAGAACTACAGCG<br>GCAGATTCACCTGCTGGTGGCTGACCACCATCAGCACAGATTTGACCTTCAGCGTG<br>AAGAGCAGCAGAGGCAGCAGCGACCCCCAGGGCGTGACCTGCGGCGCCGCCACCCT<br>GAGCGCCGAGAGAGTGAGAGGTGACAACAAGGAGTACGAGTACAGCGTGGAGTGCC<br>AGGAAGATAGCGCCTGCCCCGCCGCCGAGGAGAGCCTGCCCATCGAGGTGATGGTG<br>GACGCCGTGCACAAGCTGAAGTACGAGAACTACACCAGCAGCTTCTTCATCAGAGA<br>TATCATCAAGCCCGACCCGCCGAAGAACCTGCAGCTGAAGCCCCTGAAGAACAGCC<br>GGCAGGTGGAGGTGAGCTGGGAGTACCCCGACACCTGGAGCACCCCCCACAGCTAC<br>TTCAGCCTGACCTTCTGCGTGCAGGTGCAGGGCAAGAGCAAGAGAGAGAAGAAAGA<br>TAGAGTGTTCACAGATAAGACCAGCGCCACCGTGATCTGCAGAAAGAACGCCAGCA<br>TCAGCGTGAGAGCCCAAGATAGATACTACAGCAGCAGCTGGAGCGAGTGGGCCAGC<br>GTGCCCTGCAGCGGCGGCGGCGGCGGCAGCAGAAACCTGCCCGTGGCCACCCC<br>CGACCCCGGCATGTTCCCCTGCCTGCACCACAGCCAGAACCTGCTGAGAGCCGTGA<br>GCAACATGCTGCAGAAGGCCCGGCAGACCCTGGAGTTCTACCCCTGCACCAGCGAG<br>GAGATCGACCACGAAGATATCACCAAAGATAAGACCAGCACCGTGGAGGCCTGCCT<br>GCCCCTGGAGCTGACCAAGAATGAAAGCTGCCTGAACAGCAGAGAGACCAGCTTCA<br>TCACCAACGGCAGCTGCCTGGCCAGCAGAAAGACCAGCTTCATGATGGCCCTGTGC<br>CTGAGCAGCATCTACGAGGACCTGAAGATGTACCAGGTGGAGTTCAAGACCATGAA<br>CGCCAAGCTGCTGATGGACCCCAAGCGGCAGATCTTCCTGGACCAGAACATGCTGG<br>CCGTGATCGACGAGCTGATGCAGGCCCTGAACTTCAACAGCGAGACCGTGCCCCAG<br>AAGAGCAGCCTGGAGGAGCCCGACTTCTACAAGACCAAGATCAAGCTGTGCATCCT<br>GCTGCACGCCTTCAGAATCAGAGCCGTGACCATCGACAGAGTGATGAGCTACCTGA<br>ACGCCAGCTGATAATAGGCTGGAGCCTCGGTGGCCATGCTTCTTGCCCCTTGGGCC<br>TCCCCCCAGCCCCTCCTCCCCTTCCTGCACCCGTACCCCCCAAACACCATTGTCAC<br>ACTCCAGTGGTCTTTGAATAAAGTCTGAGTGGGCGGC |
| 107 | hIL12AB_007<br>(5'UTR ORF<br>3'UTR) | TCAAGCTTTTGGACCCTCGTACAGAAGCTAATACGACTCACTATAGGGAAATAAGA<br>GAGAAAAGAAGAGTAAGAAGAAATATAAGAGCCACCATGTGCCACCAGCAGCTTGT<br>CATCTCCTGGTTCTCTCTTGTCTTCCTTGCTTCTCCTCTTGTGGCCATCTGGGAGC<br>TGAAGAAGGACGTTTACGTAGTGGAGTTGGATTGGTACCCTGACGCACCTGGAGAA<br>ATGGTGGTTCTCACCTGTGACACTCCTGAGGAGGACGGTATCACCTGGACGTTGGA<br>CCAGTCTTCTGAGGTTCTTGGCAGTGGAAAAACTCTTACTATTCAGGTGAAGGAGT<br>TTGGAGATGCTGGCCAGTACACCTGCCACAAGGGTGGTGAAGTTCTCAGCCACAGT<br>TTACTTCTTCTTCACAAGAAGGAGGATGGCATCTGGTCTACTGACATTTTAAAGA<br>CCAGAAGGAGCCCAAGAACAAAACATTCCTTCGTTGTGAAGCCAAGAACTACAGTG<br>GTCGTTTCACCTGCTGGTGGCTTACTACTATTTCTACTGACCTTACTTTCTCTGTG<br>AAGTCTTCTCGTGGCTCTTCTGACCCTCAGGGTGTCACCTGTGGGGGCTGCTACTCT<br>TTCTGCTGAGCGTGTGCGTGGTGACAACAAGGAGTATGAATACTCGGTGGAGTGCC<br>AGGAAGATTCTGCCTGCCCTGCTGCTGAGGAGTCTCTTCCTATTGAGGTGATGGTG<br>GATGCTGTGCACAAGTTAAAATATGAAAACTACACTTCTTCTTTCTTCATTCGTGA<br>CATTATAAAACCTGACCCTCCCAAGAACCTTCAGTTAAAACCTTTAAAAAACTCTC<br>GTCAGGTGGAGGTGTCCTGGGAGTACCCTGACACGTGGTCTACTCCTCACTCCTAC<br>TTCTCTCTTACTTTCTGTGTCCAGGTGCAGGGCAAGTCCAAGCGTGAGAAGAAGGA<br>CCGTGTCTTCACTGACAAAACATCTGCTACTGTCATCTGCAGGAAGAATGCATCCA<br>TCTCTGTGCGTGCTCAGGACCGTTACTACAGCTCTTCCTGGTCTGAGTGGGCTTCT<br>GTGCCCTGCTCTGGCGGCGGCGGCGGCGGCAGCAGAAATCTTCCTGTGGCTACTCC<br>TGACCCTGGCATGTTCCCCTGCCTTCACCACTCGCAGAACCTTCTTCGTGCTGTGA<br>GCAACATGCTTCAGAAGGCTCGTCAAACTTTAGAATTCTACCCCTGCACTTCTGAG<br>GAGATTGACCATGAAGATATCACCAAAGATAAAACATCTACTGTGGAGGCCTGCCT<br>TCCTTTAGAGCTGACCAAGAATGAATCCTGCTTAAATTCTCGTGAGACGTCTTTCA<br>TCACCAATGGCAGCTGCCTTGCCTCGCGCAAAACATCTTTCATGATGGCTCTTTGC<br>CTTTCTTCCATCTATGAAGATTTAAAAATGTACCAGGTGGAGTTCAAGACCATGAA<br>TGCAAAGCTTCTCATGGACCCCAAGCGTCAGATATTTTTGGACCAGAACATGCTTG<br>CTGTCATTGATGAGCTCATGCAGGCTTTAAACTTCAACTCTGAGACGGTGCCTCAG<br>AAGTCTTCTTTAGAAGAGCCTGACTTCTACAAGACCAAGATAAAACTTTGCATTCT<br>TCTTCATGCTTTCCGCATCCGTGTGTGACTATTGACCGTGTGATGTCCTACTTAA<br>ATGCTTCTTGATAATAGGCTGGAGCCTCGGTGGCCAAGCTTCTTGCCCCTTGGGCC |

| SEQ ID NO | Description | Sequence |
|---|---|---|
| | | TCCCCCCAGCCCCTCCTCCCCTTCCTGCACCCGTACCCCCCAAACACCATTGTCAC<br>ACTCCAGTGGTCTTTGAATAAAGTCTGAGTGGGCGGC |
| 108 | hIL12AB_008<br>(5'UTR ORF<br>3'UTR) | TCAAGCTTTTGGACCCTCGTACAGAAGCTAATACGACTCACTATAGGGAAATAAGA<br>GAGAAAAGAAGAGTAAGAAGAAATATAAGAGCCACCATGTGTCATCAACAACTCGT<br>GATTAGCTGGTTCAGTCTCGTGTTCCTGGCCTCTCCGCTGGTGGCCATCTGGGAGC<br>TTAAGAAGGACGTGTACGTGGTGGAGCTCGATTGGTACCCCGACGCACCTGGCGAG<br>ATGGTGGTGCTAACCTGCGATACCCCCGAGGAGGACGGGATCACTTGGACCCTGGA<br>TCAGAGTAGCGAAGTCCTGGGCTCTGGCAAAACACTCACAATCCAGGTGAAGGAAT<br>TCGGAGACGCTGGTCAGTACACTTGCCACAAGGGGGTGAAGTGCTGTCTCACAGC<br>CTGCTGTTACTGCACAAGAAGGAGGATGGGATCTGGTCAACCGACATCCTGAAGGA<br>TCAGAAGGAGCCTAAGAACAAGACCTTTCTGAGGTGTGAAGCTAAGAACTATTCCG<br>GAAGATTCACTTGCTGGTGGTTGACCACAATCAGCACTGACCTGACCTTTTCCGTG<br>AAGTCCAGCAGAGGAAGCAGCGATCCTCAGGGCGTAACGTGCGGCGCGGCTACCCT<br>GTCAGCTGAGCGGGTTAGAGGCGACAACAAAGAGTATGAGTACTCCGTGGAGTGTC<br>AGGAAGATAGCGCCTGCCCCGCAGCCGAGGAGAGTCTGCCCATCGAGGTGATGGTG<br>GACGCTGTCCATAAGTTAAAATACGAAAATTACACAAGTTCCTTTTTCATCCGCGA<br>TATTATCAAACCCGATCCCCCCAAGAACCTGCAGCTGAAGCCCCTGAAGAATAGCC<br>GACAGGTGGAAGTCTCTTGGGAGTATCCTGACACCTGGTCCACGCCTCACAGCTAC<br>TTTAGTCTGACTTTCTGTGTCCAGGTCCAGGGCAAGAGCAAGAGAGAGAAAAGGA<br>TAGAGTGTTTACTGACAAAACATCTGCTACAGTCATCTGCAGAAAGAACGCCAGTA<br>TCTCAGTGAGGGCGCAAGATAGATACTACAGTAGTAGCTGGAGCGAATGGGCTAGC<br>GTGCCCTGTTCAGGGGCGGCGGAGGGGCTCCAGGAATCTGCCCGTGGCCACCCC<br>CGACCCTGGGATGTTCCCTTGCCTCCATCACTCACAGAACCTGCTCAGAGCAGTGA<br>GCAACATGCTCCAAAAGGCCCGCCAGACCCTGGAGTTTTACCCTTGTACTTCAGAA<br>GAGATCGATCACGAAGATATAACAAAGGATAAAACCAGCACCGTGGAGGCCTGTCT<br>GCCTCTGGAACTCACAAAGAATGAAAGCTGTCTGAATTCCAGGGAAACCTCCTTCA<br>TTACTAACGGAAGCTGTCTCGCATCTCGCAAAACATCATTCATGATGGCCCTCTGC<br>CTGTCTTCTATCTATGAAGATCTCAAGATGTATCAGGTGGAGTTCAAAACAATGAA<br>CGCCAAGCTGCTGATGGACCCCAAGCGGCAGATCTTCCTGGACCAGAACATGCTGG<br>CAGTGATCGATGAGCTGATGCAAGCCTTGAACTTCAACTCAGAGACGGTGCCGCAA<br>AAGTCCTCGTTGGAGGAACCAGATTTTTACAAAACCAAAATCAAGCTGTGTATCCT<br>TCTTCACGCCTTTCGGATCAGAGCCGTGACTATCGACCGGGTGATGTCATACCTGA<br>ATGCTTCCTGATAATAGGCTGGAGCCTCGGTGGCCATGCTTCTTGCCCCTTGGGCC<br>TCCCCCCAGCCCCTCCTCCCCTTCCTGCACCCGTACCCCCCAAACACCATTGTCAC<br>ACTCCAGTGGTCTTTGAATAAAGTCTGAGTGGGCGGC |
| 109 | hIL12AB_009<br>(5'UTR ORF<br>3'UTR) | TCAAGCTTTTGGACCCTCGTACAGAAGCTAATACGACTCACTATAGGGAAATAAGA<br>GAGAAAAGAAGAGTAAGAAGAAATATAAGAGCCACCATGTGCCACCAGCAGCTGGT<br>CATCAGCTGGTTTAGCCTGGTCTTCCTGGCCAGCCCCCTGGTGGCCATCTGGGAGC<br>TGAAGAAAGACGTCTACGTAGTAGAGTTGGATTGGTACCCAGACGCACCTGGAGAA<br>ATGGTGGTTCTCACCTGCGACACGCCAGAAGAAGACGGTATCACCTGGACGCTGGA<br>CCAGAGCAGCGAAGTACTGGGCAGTGGAAAAACGCTGACCATACAAGTAAAAGAAT<br>TTGGCGATGCTGGCCAGTACACCTGCCACAAAGGAGGAGAAGTACTGAGCCACAGC<br>CTGCTGCTGCTGCACAAGAAAGAAGATGGCATCTGGAGCACCGACATTTTAAAAGA<br>CCAGAAGGAGCCCAAGAACAAAACCTTCCTTCGATGTGAGGCGAAGAACTACAGTG<br>GCCGCTTCACCTGCTGGTGGCTCACCACCATCAGCACCGACCTCACCTTCTCGGTG<br>AAGAGCAGCCGTGGTAGCTCAGACCCCCAAGGAGTCACCTGTGGGGCGGCCACGCT<br>GTCGGCAGAAAGAGTTCGAGGCGACAACAAGGAATATGAATACTCGGTGGAATGTC<br>AAGAAGATTCGGCCTGCCCGGCGGCAGAAGAAAGTCTGCCCATAGAAGTCATGGTG<br>GATGCTGTTCACAAATTAAAATATGAAAACTACACCAGCAGCTTCTTCATCAGAGA<br>TATCATCAAGCCAGACCCCCCCAAGAACCTGCAGCTGAAGCCCCTGAAGAACAGCC<br>GGCAGGTGGAAGTTTCCTGGGAGTACCCAGATACGTGGAGCACGCCGCACAGCTAC<br>TTCAGCCTCACCTTCTGTGTACAAGTACAAGGCAAGAGCAAGAGAGAGAAGAAAGA<br>TCGTGTCTTCACCGACAAAACCTCGGCGACGGTCATCTGCAGGAAGAATGCAAGCA<br>TCTCGGTTCGAGCCCAGGACCGCTACTACAGCAGCAGCTGGAGTGAGTGGGCCTCG<br>GTGCCCTGCAGTGGTGGCGGCGGCGGCAGCAGAAACCTTCCTGTGGCCACGCC<br>GGACCCTGGCATGTTTCCGTGCCTGCACCACAGCCAAAATTTATTACGAGCTGTTA<br>GCAACATGCTGCAGAAAGCACGGCAAACTTTAGAATTCTACCCCTGCACCTCAGAA<br>GAAATAGACCATGAAGATATCACCAAAGATAAAACCAGCACTGTAGAGGCCTGCCT<br>GCCCCTGGAGCTCACCAAGAACGAGAGCTGCCTCAATAGCAGAGAGACCAGCTTCA<br>TCACCAATGGCAGCTGCCTGGCCAGCAGGAAAACCAGCTTCATGATGGCGCTCTGC<br>CTGAGCAGCATCTATGAAGATCTGAAGATGTACCAAGTAGAATTTAAAACCATGAA<br>TGCCAAGCTGCTCATGGACCCCAAGCGGCAGATATTCCTCGACCAAAACATGCTGG<br>CTGTCATTGATGAGCTCATGCAAGCATTAAACTTCAACTCAGAGACGGTGCCCCAG<br>AAGAGCAGCCTGGAGGAGCCAGATTTCTACAAAACCAAGATCAAGCTCTGCATCTT<br>ATTACATGCCTTCCGCATCCGGGCGGTCACCATTGACCGTGTCATGTCCTACTTAA<br>ATGCCAGCTGATAATAGGCTGGAGCCTCGGTGGCCATGCTTCTTGCCCCTTGGGCC<br>TCCCCCCAGCCCCTCCTCCCCTTCCTGCACCCGTACCCCCCAAACACCATTGTCAC<br>ACTCCAGTGGTCTTTGAATAAAGTCTGAGTGGGCGGC |

| SEQ ID NO | Description | Sequence |
|---|---|---|
| 110 | hIL12AB_010 (5'UTR ORF 3'UTR) | TCAAGCTTTTGGACCCTCGTACAGAAGCTAATACGACTCACTATAGGGAAATAAGA GAGAAAAGAAGAGTAAGAAGAAATATAAGAGCCACCATGTGCCACCAGCAGCTTGT CATCTCCTGGTTTTCTCTTGTCTTCCTCGCTTCTCCTCTTGTGGCCATCTGGGAGC TGAAGAAAGACGTCTACGTAGTAGAGTTGGATTGGTACCCGGACGCTCCTGGAGAA ATGGTGGTTCTCACCTGCGACACTCCTGAAGAAGACGGTATCACCTGGACGCTGGA CCAAAGCAGCGAAGTTTTAGGCTCTGGAAAAACGCTGACCATACAAGTAAAAGAAT TTGGCGACGCTGGCCAGTACACGTGCCACAAAGGAGGAGAAGTTTTAAGCCACAGT TTACTTCTTCTTCACAAGAAAGAAGATGGCATCTGGAGTACAGATATTTTAAAAGA CCAGAAGGAGCCTAAGAACAAAACCTTCCTCCGCTGTGAAGCTAAGAACTACAGTG GTCGTTTCACCTGCTGGTGGCTCACCACCATCTCCACTGACCTCACCTTCTCTGTA AAATCAAGCCGTGGTTCTTCTGACCCCCAAGGAGTCACCTGTGGGGCTGCCACGCT CAGCGCTGAAAGAGTTCGAGGCGACAACAAGGAATATGAATATTCTGTGGAATGTC AAGAAGATTCTGCCTGCCCGGCGGCAGAAGAAAGTCTTCCCATAGAAGTCATGGTG GACGCTGTTCACAAATTAAAATATGAAAACTACACCAGCAGCTTCTTCATTCGTGA CATCATCAAACCAGACCCTCCTAAGAACCTTCAGTTAAAACCGCTGAAGAACAGCC GGCAGGTGGAAGTTTCTGGGAGTACCCAGATACGTGGAGTACGCCGCACTCCTAC TTCAGTTTAACCTTCTGTGTACAAGTACAAGGAAAATCAAAAAGAGAGAAGAAAGA TCGTGTCTTCACTGACAAAACATCTGCCACGGTCATCTGCCGTAAGAACGCTTCCA TCTCGGTTCGAGCCCAGGACCGCTACTACAGCAGCAGCTGGAGTGAGTGGGCATCT GTTCCCTGCAGTGGTGGCGGCGGCGGCAGCCGCAACCTTCCTGTGGCCACGCC GGACCCTGGCATGTTCCCGTGCCTTCACCACTCGCAAAATCTTCTTCGTGCTGTTT CTAACATGCTGCAGAAGGCGCGGCAAACTTTAGAATTCTACCCGTGCACTTCTGAA GAAATAGACCATGAAGATATCACCAAAGATAAAACCAGCACGGTGGAGGCCTGCCT TCCTTTAGAACTTACTAAGAACGAAAGTTGCCTTAACAGCCGTGAGACCAGCTTCA TCACCAATGGCAGCTGCCTTGCTAGCAGGAAGACCAGCTTCATGATGGCGCTGTGC CTTTCTTCCATCTATGAAGATCTTAAGATGTACCAAGTAGAATTTAAAACCATGAA TGCCAAATTATTAATGGACCCCAAGCGGCAGATATTCCTCGACCAAAACATGCTGG CTGTCATTGATGAGCTCATGCAAGCATTAAACTTCAACTCAGAAACTGTTCCCCAG AAGTCATCTTTAGAAGAACCAGATTTCTACAAAACAAAAATAAAACTCTGCATTCT TCTTCATGCCTTCCGCATCCGTGCTGTCACCATTGACCGTGTCATGTCCTACTTAA ATGCTTCTTGATAATAGGCTGGAGCCTCGGTGGCCATGCTTCTTGCCCCTTGGGCC TCCCCCCAGCCCCTCCTCCCCTTCCTGCACCCGTACCCCCCAAACACCATTGTCAC ACTCCAGTGGTCTTTGAATAAAGTCTGAGTGGGCGGC |
| 111 | hIL12AB_011 (5'UTR ORF 3'UTR) | TCAAGCTTTTGGACCCTCGTACAGAAGCTAATACGACTCACTATAGGGAAATAAGA GAGAAAAGAAGAGTAAGAAGAAATATAAGAGCCACCATGTGCCACCAGCAGCTGGT GATCAGCTGGTTCAGCCTGGTTCTCGGCCAGCCCCTGGTGGCCATCTGGGAGC TGAAGAAGGACGTGTACGTGGTGGAGTTGGATTGGTACCCGGACGCCGGGGAG ATGGTGGTGCTGACGTGCGACACGCCGGAGGAGGACGGGATCACGTGGACGCTGGA CCAGAGCAGCGAGGTGCTGGGGAGCGGGAAGACGCTGACGATCCAGGTGAAGGAGT TCGGGGACGCGGGGCAGTACACGTGCCACAAGGGGGGGAGGTGCTGAGCCACAGC CTGCTGCTGCTGCACAAGAAGGAGGACGGGATCTGGAGCACAGATATCCTGAAGGA CCAGAAGGAGCCGAAGAACAAGACGTTCCTGAGGTGCGAGGCGAAGAACTACAGCG GGAGGTTCACGTGCTGGTGGCTGACGACGATCAGCACGGACCTGACGTTCAGCGTG AAGAGCAGCAGGGGGAGCAGCGACCCGCAGGGGGTGACGTGCGGGGCGGCGACGCT GAGCGCGGAGAGGGTGAGGGGTGACAACAAGGAGTACGAGTACAGCGTGGAGTGCC AGGAAGATAGCGCGTGCCCGGCGGCGGAGGAGCCTGCCGATCGAGGTGATGGTG GACGCGGTGCACAAGCTGAAGTACGAGAACTACACGAGCAGCTTCTTCATCAGAGA TATCATCAAGCCGGACCCCGCCGAAGAACCTGCAGCTGAAGCCGCTGAAGAACAGCA GGCAGGTGGAGGTGAGCTGGGAGTACCCAGATACGTGGAGCACGCCGCACAGCTAC TTCAGCCTGACGTTCTGCGTGCAGGTGCAGGGGAAGAGCAAGAGGGAGAAGAAAGA TAGGGTGTTCACAGATAAGACGAGCGCGACGGTGATCTGCAGGAAGAACGCGAGCA TCAGCGTGAGGGCGCAAGATAGGTACTACAGCAGCAGCTGGAGCGAGTGGGCGAGC GTGCCCGTGCAGCGGGGGGGGGGGGGGGGAGCAGGAACCTGCCGGTGGCGACGCC GGACCCGGGGATGTTCCCGTGCCTGCACCACAGCCAGAACCTGCTGAGGGCGGTGA GCAACATGCTGCAGAAGGCGAGGCAGACGCTGGAGTTCTACCCGTGCACGAGCGAG GAGATCGACCACGAAGATATCACGAAAGATAAGAGCACGGTGGAGGCGTGCCT GCCGCTGGAGCTGACGAAGAACGAGAGCTGCCTGAACAGCAGGGAGACGAGCTTCA TCACGAACGGGAGCTGCCTGGCGAGCAGGAAGACGAGCTTCATGATGGCGCTGTGC CTGAGCAGCATCTACGAGGACCTGAAGATGTACCAGGTGGAGTTCAAGACGATGAA CGCGAAGCTGCTGATGGACCCGAAGAGGCAGATCTTCCTGGACCAGAACATGCTGG CGGTGATCGACGAGCTGATGCAGGCGCTGAACTTCAACAGCGAGACGGTGCCGCAG AAGAGCAGCCTGGAGGAGCCAGATTTCTACAAGACGAAGATCAAGCTGTGCATCCT GCTGCACGCGTTCAGGATCAGGGCGGTGACGATCGACAGGGTGATGAGCTACCTGA ACGCGAGCTGATAATAGGCTGGAGCCTCGGTGGCCATGCTTCTTGCCCCTTGGGCC TCCCCCCAGCCCCTCCTCCCCTTCCTGCACCCGTACCCCCCAAACACCATTGTCAC ACTCCAGTGGTCTTTGAATAAAGTCTGAGTGGGCGGC |
| 112 | hIL12AB_012 (5'UTR ORF 3'UTR) | TCAAGCTTTTGGACCCTCGTACAGAAGCTAATACGACTCACTATAGGGAAATAAGA GAGAAAAGAAGAGTAAGAAGAAATATAAGAGCCACCATGTGCCATCAGCAGCTGGT GATCAGCTGGTTCAGCCTCGTGTTCTGGCCAGCCCCTGGTGGCCATTTGGGAAC TCAAGAAGGACGTGTACGTTGTGGAACTCGACTGGTACCCTGACGCCCCAGGCGAA ATGGTGGTCTTAACCTGCGACACCCCTGAGGAGGACGGAATCACCTGGACCTTGGA |

SUMMARY OF SEQUENCES

| SEQ ID NO | Description | Sequence |
|---|---|---|
| | | CCAGAGCTCCGAGGTCCTCGGCAGTGGCAAGACCCTGACCATACAGGTGAAAGAAT TTGGAGACGCAGGGCAATACACATGTCACAAGGGCGGGGAGGTTCTTTCTCACTCC CTTCTGCTTCTACATAAAAAGGAAGACGGAATTTGGTCTACCGACATCCTCAAGGA CCAAAAGGAGCCTAAGAATAAAACCTTCTTACGCTGTGAAGCTAAAAACTACAGCG GCAGATTCACTTGCTGGTGGCTCACCACCATTTCTACCGACCTGACCTTCTCGGTG AAGTCTTCAAGGGGCTCTAGTGATCCACAGGGAGTGACATGCGGGGCCGCCACACT GAGCGCTGAACGGGTGAGGGGCGATAACAAGGAGTATGAATACTCTGTCGAGTGTC AGGAGGATTCAGCTTGTCCCGCAGCTGAAGAGTCACTCCCCATAGAGGTTATGGTC GATGCTGTGCATAAACTGAAGTACGAAAACTACACCAGCAGCTTCTTCATTAGAGA TATTATAAAACCTGACCCCCCAAGAACCTGCAACTTAAACCCCTGAAAAACTCTC GGCAGGTCGAAGTTAGCTGGGAGTACCCTGATACTTGGTCCACCCCCCACTCGTAC TTCTCACTGACTTTCTGTGTGCAGGTGCAGGGCAAGAGCAAGAGAGAGAAAAAAGA TCGTGTATTCACAGATAAGACCTCTGCCACCGTGATCTGCAGAAAAAACGCTTCCA TCAGTGTCAGAGCCCAAGACCGGTACTATAGTAGTAGCTGGAGCGAGTGGGCAAGT GTCCCCTGCTCTGGCGGCGGAGGGGCGGCTCTCGAAACCTCCCCGTCGCTACCCC TGATCCAGGAATGTTCCCTTGCCTGCATCACTCACAGAATCTGCTGAGAGCGGTCA GCAACATGCTGCAGAAAGCTAGGCAAACACTGGAGTTTTATCCTTGTACCTCAGAG GAGATCGACCACGAGGATATTACCAAAGATAAGACCAGCACGGTGGAGGCCTGCTT GCCCCTGGAACTGACAAAGAATGAATCCTGCCTTAATAGCCGTGAGACCTCTTTTA TAACAAACGGATCCTGCCTGGCCAGCAGGAAGACCTCCTTCATGATGGGCCTCTGC CTGTCCTCAATCTACGAAGACCTGAAGATGTACCAGGTGGAATTTAAAACTATGAA CGCCAAGCTGTTGATGGACCCCAAGCGGCAGATCTTTCTGGATCAAATATGCTGG CTGTGATCGACGAACTGATGCAGGCCCTCAACTTTAACAGCGAGACCGTGCCACAA AAGAGCAGTCTTGAGGAGCCCGACTTCTACAAGACCAAGATCAAGCTGTGCATCCT CCTTCATGCCTTCAGGATAAGAGCTGTCACCATCGACAGAGTCATGAGTTACCTGA ATGCATCCTGATAATAGGCTGGAGCCTCGGTGGCCATGCTTCTTGCCCCTTGGGCC TCCCCCCAGCCCCTCCTCCCCTTCCTGCACCCGTACCCCCCAAACACCATTGTCAC ACTCCAGTGGTCTTTGAATAAAGTCTGAGTGGGCGGC |
| 113 | hIL12AB_013 (5'UTR ORF 3'UTR) | TCAAGCTTTTGGACCCTCGTACAGAAGCTAATACGACTCACTATAGGGAAATAAGA GAGAAAAGAAGAGTAAGAAGAAATATAAGAGCCACCATGTGCCACCAGCAGCTGGT CATCTCCTGGTTCAGTCTTGTCTTCCTGGCCTCGCCGCTGGTGGCCATCTGGGAGC TGAAGAAAGACGTTTACGTAGTAGAGTTGGATTGGTACCCAGACGCACCTGGAGAA ATGGTGGTCCTCACCTGTGACACGCCAGAAGAAGACGGTATCACCTGGACGCTGGA CCAGAGCAGTGAAGTTCTTGGAAGTGGAAAAACGCTGACCATACAAGTAAAAGAAT TTGGAGATGCTGGCCAGTACACCTGCCACAAAGGAGGAGAAGTTCTCAGCCACAGT TTATTATTACTTCACAAGAAAGAAGATGGCATCTGGTCCACAGATATTTTTAAAGA CCAGAAGGAGCCCAAAAATAAAAACATTTCTTCGATGTGAGGCCAAGAACTACAGTG GTCGTTTCACCTGCTGGTGGCTGACCACCATCTCCACAGACCTCACCTTCAGTGTA AAAAGCAGCCGTGGTTCTTCTGACCCCCAAGGAGTCACCTGTGGGGCTGCCACGCT CTCTGCAGAAAGAGTTCGAGGTGACAACAAAGAATATGAGTACTCGGTGGAATGTC AAGAAGATTCGGCCTGCCCAGCTGCTGAGGAGAGTCTTCCCATAGAAGTCATGGTG GATGCTGTTCACAAATTAAAATATGAAAACTACACCAGCAGCTTCTTCATCAGAGA TATCATCAAACCTGACCCGCCCAAGAACTTACAGCTGAAGCCGCTGAAAAACAGCC GGCAGGTAGAAGTTTCCTGGGAGTACCCAGATACCTGGTCCACGCCGCACTCCTAC TTCTCCCTCACCTTCTGTGTACAAGTACAAGGCAAGAGCAAGAGAGAGAAGAAAGA TCGTGTCTTCACAGATAAAACATCAGCCACGGTCATCTGCAGGAAAATGCCAGCA TCTCGGTGCGGGCCCAGGACCGCTACTACAGCAGCAGCTGGAGTGAGTGGGCATCT GTGCCCTGCAGTGGTGGTGGGGGTGGTGGCAGCAGAAACCTTCCTGTGGCCACTCC AGACCCTGGCATGTTCCCGTGCCTTCACCACTCCCAAAATTTACTTCGAGCTGTTT CTAACATGCTGCAGAAAGCACGGCAAACTTTAGAATTCTACCCGTGCACTTCTGAA GAAATTGACCATGAAGATATCACAAAAGATAAAACCAGCACAGTGGAGGCCTGTCT TCCTTTAGAGCTGACCAAAAATGAATCCTGCCTCAACAGCAGAGAGACCAGCTTCA TCACCAATGGCAGCTGCCTGGCCTCCAGGAAAACCAGCTTCATGATGGCGCTCTGC CTCAGCTCCATCTATGAAGATTTGAAGATGTACCAAGTAGAATTTAAAACCATGAA TGCCAAATTATTAATGGACCCCAAGAGGCAGATATTTTTAGATCAAAACATGCTGG CAGTTATTGATGAGCTCATGCAAGCATTAAACTTCAACAGTGAGACGGTACCTCAA AAAAGCAGCCTTGAAGAGCCAGATTTCTACAAAACCAAGATCAAACTCTGCATTTT ACTTCATGCCTTCCGCATCCGGGCGGTCACCATTGACCGTGTCATGTCCTACTTAA ATGCCTCGTGATAATAGGCTGGAGCCTCGGTGGCCATGCTTCTTGCCCCTTGGGCC TCCCCCCAGCCCCTCCTCCCCTTCCTGCACCCGTACCCCCCAAACACCATTGTCAC ACTCCAGTGGTCTTTGAATAAAGTCTGAGTGGGCGGC |
| 114 | hIL12AB_014 (5'UTR ORF 3'UTR) | TCAAGCTTTTGGACCCTCGTACAGAAGCTAATACGACTCACTATAGGGAAATAAGA GAGAAAAGAAGAGTAAGAAGAAATATAAGAGCCACCATGTGCCACCAGCAGCTTGT GATTTCTTGGTTCTCTCTTGTGTTCCTTGCTTCTCCTCTTGTGGCTATTTGGGAGT TAAAAAAGGACGTGTACGTGGTGGAGCTTGACTGGTACCCTGACGCACCTGGCGAG ATGGTGGTGCTTACTTGTGACACTCCTGAGGAGGACGGCATTACTTGGACGCTTGA CCAGTCTTCTGAGGTGCTTGGCTCTGGCAAAACACTTACTATTCAGGTGAAGGAGT TCGGGGATGCTGGCCAGTACACTTGCCACAAGGGCGGCGAGGTGCTTTCTCACTCT CTTCTTCTTCTTCACAAGAAGGAGGACGGCATTTGGTCTACTGACATTTTAAAGA CCAGAAGGAGCCCAAGAACAAAACATTCCTTCGTTGCGAGGCCAAGAACTACTCTG GCCGTTTCACTTGCTGGTGGCTTACTACTATTTCTACTGACCTTACTTTCTCTGTG |

SUMMARY OF SEQUENCES

| SEQ ID NO | Description | Sequence |
|---|---|---|
| | | AAGTCTTCTCGTGGCTCTTCTGACCCTCAGGGCGTGACTTGTGGGGCTGCTACTCT TTCTGCTGAGCGTGTGCGTGGTGACAACAAGGAGTACGAGTACTCTGTGGAGTGCC AGGAAGATTCTGCTTGCCCTGCTGCTGAGGAGTCTCTTCCTATTGAGGTGATGGTG GATGCTGTGCACAAGTTAAAATACGAGAACTACACTTCTTCTTTCTTCATTCGTGA CATTATTAAGCCTGACCCTCCCAAGAACCTTCAGTTAAAACCTTTAAAAAACTCTC GTCAGGTGGAGGTGTCTTGGGAGTACCCTGACACTTGGTCTACTCCTCACTCTTAC TTCTCTCTTACTTTCTGCGTGCAGGTGCAGGGCAAGTCTAAGCGTGAGAAGAAGGA CCGTGTGTTCACTGACAAAACATCTGCTACTGTGATTTGCAGGAAGAATGCATCTA TTTCTGTGCGTGCTCAGGACCGTTACTACTCTTCTTCTTGGTCTGAGTGGGCTTCT GTGCCTTGCTCTGGCGGCGGCGGCGGCGGCTCCAGAAATCTTCCTGTGGCTACTCC TGACCCTGGCATGTTCCCTTGCCTTCACCACTCTCAGAACCTTCTTCGTGCTGTGA GCAACATGCTTCAGAAGGCTCGTCAAACTCTTGAGTTCTACCCTTGCACTTCTGAG GAGATTGACCACGAAGATATCACCAAAGATAAAACATCTACTGTGGAGGCTTGCCT TCCTCTTGAGCTTACCAAGAATGAATCTTGCTTAAATTCTCGTGAGACGTCTTTCA TCACCAACGGCTCTTGCCTTGCCTCGCGCAAAACATCTTTCATGATGGCTCTTTGC CTTTCTTCTATTTACGAAGATTTAAAAATGTACCAGGTGGAGTTCAAAACAATGAA TGCAAAGCTTCTTATGGACCCCAAGCGTCAGATTTTCCTTGACCAGAACATGCTTG CTGTGATTGACGAGCTTATGCAGGCTTTAAATTTCAACTCTGAGACGGTGCCTCAG AAGTCTTCTCTTGAGGAGCCTGACTTCTACAAGACCAAGATTAAGCTTTGCATTCT TCTTCATGCTTTCCGTATTCGTGCTGTGACTATTGACCGTGTGATGTCTTACTTAA ATGCTTCTTGATAATAGGCTGGAGCCTCGGTGGCCATGCTTCTTGCCCCTTGGGCC TCCCCCCAGCCCTCCTCCCCTTCCTGCACCCGTACCCCCCAAACACCATTGTCAC ACTCCAGTGGTCTTTGAATAAAGTCTGAGTGGGCGGC |
| 115 | hIL12AB_015 (5'UTR ORF 3'UTR) | TCAAGCTTTTGGACCCTCGTACAGAAGCTAATACGACTCACTATAGGGAAATAAGA GAGAAAAGAAGAGTAAGAAGAAATATAAGAGCCACCATGTGTCACCAGCAGCTGGT GATCAGCTGGTTTAGCCTGGTGTTTCTGGCCAGCCCCTGGTGGCCATCTGGGAAC TGAAGAAAGACGTGTACGTGGTAGAACTGGATTGGTATCCGGACGCTCCCGGCGAA ATGGTGGTGCTGACCTGTGACACCCCCGAAGAAGACGGAATCACCTGGACCCTGGA CCAGAGCAGCGAGGTGCTGGGCAGCGGCAAAACCCTGACCATCCAAGTGAAAGAGT TTGGCGATGCCGGCCAGTACACCTGTCACAAAGGCGGCGAGGTGCTAAGCCATTCG CTGCTGCTGCTGCACAAAAAGGAAGATGGCATCTGGAGCACCGATATCCTGAAGGA CCAGAAAGAACCCAAAAATAAGACCTTTCTAAGATGCGAGGCCAAGAATTATAGCG GCCGTTTCACCTGCTGGTGGCTGACGACCATCAGCACCGATCTGACCTTCAGCGTG AAAAGCAGCAGAGGCAGCAGCGACCCCCAAGGCGTGACGTGCGGCGCCGCCACCCT GAGCGCCGAGAGAGTGAGAGGCGACAACAAGGAGTATGAGTACAGCGTGGAGTGCC AGGAAGATAGCGCCTGCCCCGCCGCCGAGGAGAGCCTGCCCATCGAGGTGATGGTG GATGCCGTGCACAAGCTGAAGTATGAAAACTACACCAGCAGCTTCTTCATCAGAGA TATCATCAAACCCGACCCCCCCAAGAACCTGCAGCTGAAGCCCCTGAAGAATAGCC GGCAGGTGGAGGTGAGCTGGGAGTACCCCGACACCTGGAGCACCCCCCATAGCTAC TTCAGCCTGACCTTCTGCGTGCAGGTGCAGGGCAAGAGCAAGAGAGAAAAGAAAGA TAGAGTGTTCACAGATAAGACCAGCGCCACGGTGATCTGCAGAAAAAATGCCAGCA TCAGCGTGAGAGCCCAAGATAGATACTATAGCAGCAGCTGGAGCGAATGGGCCAGC GTGCCCTGCAGCGGCGGCGGCGGCGGCGGCAGCAGAAACCTGCCCGTGGCCACCCC CGACCCCGGCATGTTCCCCTGCCTGCACCACAGCCAAAACCTGCTGAGAGCCGTGA GCAACATGCTGCAGAAGGCCCGGCAGACCCTGGAATTTTACCCCTGCACCAGCGAA GAGATCGATCATGAAGATATCACCAAAGATAAACCAGCACCGTGGAGGCCTGTCT GCCCCTGGAACTGACCAAGAATGAGAGCTGCCTAAATAGCAGAGAGACCAGCTTCA TAACCAATGGCAGCTGCCTGGCCAGCAGAAAGACCAGCTTTATGATGGCCCTGTGC CTGAGCAGCATCTATGAAGACCTGAAGATGTACCAGGTGGAGTTCAAGACCATGAA TGCCAAGCTGCTGATGGATCCCAAGCGGCAGATCTTTCTGGATCAAAACATGCTGG CCGTGATCGATGAGCTGATGCAGGCCCTGAATTTCAACAGCGAGACCGTGCCCCAA AAAAGCAGCCTGGAAGAACCGGATTTTTATAAAACCAAAATCAAGCTGTGCATACT GCTGCATGCCTTCAGAATCAGAGCCGTGACCATCGATAGAGTGATGAGCTATCTGA ATGCCAGCTGATAATAGGCTGGAGCCTCGGTGGCCATGCTTCTTGCCCCTTGGGCC TCCCCCCAGCCCTCCTCCCCTTCCTGCACCCGTACCCCCCAAACACCATTGTCAC ACTCCAGTGGTCTTTGAATAAAGTCTGAGTGGGCGGC |
| 116 | hIL12AB_016 (5'UTR ORF 3'UTR) | TCAAGCTTTTGGACCCTCGTACAGAAGCTAATACGACTCACTATAGGGAAATAAGA GAGAAAAGAAGAGTAAGAAGAAATATAAGAGCCACCATGTGCCACCAGCAGCTGGT CATCAGCTGGTTCAGCCTGGTCTTCCTGGCCAGCCCCCTGGTGGCCATCTGGGAGC TGAAGAAGGACGTATACGTAGTGGAGTTGGATTGGTACCCAGACGCTCCTGGGGAG ATGGTGGTGCTGACCTGTGACACCCCAGAAGAGGACGGTATCACCTGGACCCTGGA CCAGAGCTCAGAAGTGCTGGGCAGTGGAAAAACCCTGACCATCCAGGTGAAGGAGT TTGGAGATGCTGGCCAGTACACCTGCCACAAGGGTGGTGAAGTGCTGAGCCACAGC CTGCTGCTGCTGCACAAGAAGGAGGATGGCATCTGGAGCACAGATATCCTGAAGGA CCAGAAGGAGCCCAAGAACAAGACCTTCCTGCGTTGTGAAGCCAAGAACTACAGTG GCCGCTTCACCTGCTGGTGGCTGACCACCATCAGCACAGACCTCACCTTCTCGGTG AAGAGCAGCAGAGGCAGCTCAGACCCCCAGGGTGTCACCTGTGGGGCGGCCACGCT GTCGGCGGAGAGATTCGAGGTGACAACAAGGAGTATGAATACTCGGTGGAGTGCC AGGAAGATTCGGCGTGCCCGGCGGCAGAAGAGCCTGCCCATAGAAGTGATGGTG GATGCTGTGCACAAGCTGAAGTATGAAAACTACACCAGCAGCTTCTTCATCAGAGA TATCATCAAGCCAGACCCGCCCAAGAACCTGCAGCTGAAGCCCCTGAAGAACAGCC |

SUMMARY OF SEQUENCES

| SEQ ID NO | Description | Sequence |
|---|---|---|
| | | GGCAGGTGGAGGTTTCCTGGGAGTACCCAGATACGTGGAGCACCCCCCACAGCTAC<br>TTCAGCCTGACCTTCTGTGTCCAGGTGCAGGGCAAGAGCAAGAGAGAGAAGAAAGA<br>TAGAGTCTTCACAGATAAGACCTCGGCCACGGTCATCTGCAGAAAGAATGCCTCCA<br>TCTCGGTTCGAGCCCAAGATAGATACTACAGCAGCAGCTGGTCAGAATGGGCCTCG<br>GTGCCCTGCAGTGGTGGCGGCGGCGGCAGCAGAAACCTGCCTGTTGCCACCCC<br>AGACCCTGGGATGTTCCCCTGCCTGCACCACAGCCAGAACTTATTACGAGCTGTTT<br>CTAACATGCTGCAGAAGGCCCGGCAGACCCTGGAGTTCTACCCCTGCACCTCAGAA<br>GAGATTGACCATGAAGATATCACCAAAGATAAGACCAGCACTGTAGAGGCCTGCCT<br>GCCCCTGGAGCTGACCAAGAATGAAAGCTGCCTGAACAGCAGAGAGACCAGCTTCA<br>TCACCAATGGAAGCTGCCTGGCCAGCAGAAAGACCAGCTTCATGATGGCCCTGTGC<br>CTGAGCAGCATCTATGAAGACCTGAAGATGTACCAGGTGGAGTTCAAGACCATGAA<br>TGCAAAGCTGCTGATGGACCCCAAGCGGCAGATATTTTTGGACCAGAACATGCTGG<br>CTGTCATTGATGAGCTGATGCAGGCCCTGAACTTCAACTCAGAAACTGTACCCCAG<br>AAGAGCAGCCTGGAGGAGCCAGATTTCTACAAGACCAAGATCAAGCTGTGCATCCT<br>GCTTCATGCTTTCAGAATCAGAGCTGTCACCATTGACCGCGTGATGAGCTACTTAA<br>ATGCCTCGTGATAATAGGCTGGAGCCTCGGTGGCCATGCTTCTTGCCCCTTGGGCC<br>TCCCCCCAGCCCTCCTCCCCTTCCTGCACCCGTACCCCCCAAACACCATTGTCAC<br>ACTCCAGTGGTCTTTGAATAAAGTCTGAGTGGGCGGC |
| 117 | hIL12AB_017<br>(5'UTR ORF<br>3'UTR) | TCAAGCTTTTGGACCCTCGTACAGAAGCTAATACGACTCACTATAGGGAAATAAGA<br>GAGAAAAGAAGAGTAAGAAGAAATATAAGAGCCACCATGTGCCACCAGCAGCTGGT<br>AATCAGCTGGTTTTCCCTCGTCTTTCTGGCATCACCCCTGGTGGCTATCTGGGAGC<br>TGAAGAAGGACGTGTACGTGGTGGAGCTGGATTGGTACCCTGACGCCCCGGGGGAA<br>ATGGTGGTGTTAACCTGCGACACGCCTGAGGAGGACGGCATCCATCCTGGACGCTGGA<br>CCAGAGCAGCGAGGTGCTTGGGTCTGGTAAAACTCTGACTATTCAGGTGAAAGAGT<br>TCGGGGATGCCGGCCAATATACTTGCCACAAGGGTGGCGAGGTGCTTTCTCATTCT<br>CTGCTCCTGCTGCACAAGAAAGAAGATGGCATTTGGTCTACTGATATTCTGAAAGA<br>CCAGAAGGAGCCCAAGAACAAGACCTTTCTGAGATGCGAGGCTAAAAACTACAGCG<br>GAAGATTTACCTGCTGGTGGCTGACCACAATCTCAACCGACCTGACATTTTCAGTG<br>AAGTCCAGCAGAGGGAGCTCCGACCCTCAGGGCGTGACCTGCGGAGCCGCCACTCT<br>GTCCGCAGAAAGAGTGAGAGGTGATAATAAGGAGTACGAGTATTCAGTCGAGTGCC<br>AAGAAGATTCTGCCTGCCCAGCCGCCGAGGAGAGCCTGCCAATCGAGGTGATGGTA<br>GATGCGGTACACAAGCTGAAGTATGAGAACTACACATCCTCCTTCTTCATAAGAGA<br>TATTATCAAGCCTGACCCACCTAAAAATCTGCAACTCAAGCCTTTGAAAAATTCAC<br>GGCAGGTGGAGGTGAGCTGGGAGTACCCTGATACTTGGAGCACCCCCCATAGCTAC<br>TTTTCGCTGACATTCTGCGTCCAGGTGCAGGGCAAGTCAAAGAGAGAAGAAGGA<br>TCGCGTGTTCACTGATAAAACAAGCGCCACAGTGATCTGCAGAAAAAACGCTAGCA<br>TTAGCGTCAGAGCACAGGACCGGTATTACTCCAGCTCCTGGAGCGAATGGGCATCT<br>GTGCCCTGCAGCGGTGGGGGCGGAGGCGGATCCAGAAACCTCCCCGTTGCCACACC<br>TGATCCTGGAATGTTCCCCTGTCTGCACCACAGCCAGAACCTGCTGAGAGCAGTGT<br>CTAACATGCTCCAGAAGGCCAGGCAGACCCTGGAGTTTTACCCCTGCACCAGCGAG<br>GAAATCGATCACGAAGATATCACCAAAGATAAAACCTCCACCGTGGAGGCCTGCCT<br>GCCCCTGGAACTGACCAAAAACGAGAGCTGCCTGAATAGCAGGGAGACCTCCTTCA<br>TCACCAACGGCTCATGCCTTGCCAGCCGGAAAACTAGCTTCATGATGGCCCTGTGC<br>CTGTCTTCGATCTATGAGGACCTGAAAATGTACCAGGTCGAATTTAAGACGATGAA<br>CGCAAAGCTGCTGATGGACCCCAAGCGGCAGATCTTTCTGGACCAGAACATGCTGG<br>CAGTCATAGATGAGTTGATGCAGGCATTAAACTTCAACAGCGAGACCGTGCCTCAG<br>AAGTCCAGCCTCGAGGAGCCAGATTTTTATAAGACCAAGATCAAACTATGCATCCT<br>GCTGCATGCTTTCAGGATTAGAGCCGTCACCATCGATCGAGTCATGTCTTACCTGA<br>ATGCTAGCTGATAATAGGCTGGAGCCTCGGTGGCCATGCTTCTTGCCCCTTGGGCC<br>TCCCCCCAGCCCTCCTCCCCTTCCTGCACCCGTACCCCCCAAACACCATTGTCAC<br>ACTCCAGTGGTCTTTGAATAAAGTCTGAGTGGGCGGC |
| 118 | hIL12AB_018<br>(5'UTR ORF<br>3'UTR) | TCAAGCTTTTGGACCCTCGTACAGAAGCTAATACGACTCACTATAGGGAAATAAGA<br>GAGAAAAGAAGAGTAAGAAGAAATATAAGAGCCACCATGTGTCACCAACAGTTAGT<br>AATCTCCTGGTTTTCTCTGGTGTTTCTGGCCAGCCCCTCGTGGCCATCTGGGAGC<br>TTAAAAAGGACGTTTACGTGGTGGAGTTGGATTGGTATCCCGACGCTCCAGGCGAA<br>ATGGTCGTGCTGACCTGCGATACCCCTGAAGAAGCGGTATCACCTGGACGCTGGA<br>CCAGTCTTCCGAGGTGCTTGGATCTGGCAAAACACTGACAATACAAGTTAAGGAGT<br>TCGGGGACGCAGGGCAGTACACCTGCCACAAAGGCGGCGAGGTCCTGAGTCACTCC<br>CTGTTACTGCTCCACAAGAAAGAGGACGGCATTTGGTCCACCGACATTCTGAAGGA<br>CCAGAAGGAGCCTAAGAATAAAACTTTCCTGAGATGCGAGGCAAAAAACTATAGCG<br>GCCGCTTTACTTGCTGGTGGCTTACAACAATCTCTACCGATTTAACTTTCTCCGTG<br>AAGTCTAGCAGAGGATCCTCTGACCCGCAAGGAGTGACTTGCGGAGCCGCCACCTT<br>GAGCGCCGAAAGAGTCCGTGGCGATAACAAAGAATACGAGTACTCCGTGGAGTGCC<br>AGGAAGATTCCGCCTGCCCAGCTGCCGAGGAGTCCCTGCCCATTGAAGTGATGGTG<br>GATGCCGTCCACAAGCTGAAGTACGAAAACTATACCAGCAGCTTCTTCATCCGGGA<br>TATCATTAAGCCCGACCCTCCTAAAAACCTGCAACTTAAGCCCCTAAAGAATAGTC<br>GGCAGGTTGAGGTCAGCTGGGAATATCCTGACACATGGAGCACCCCCCACTCTTAT<br>TTCTCCCTGACCTTCTGCGTGCAGGTGCAGGGCAAGAGTAAACGGGAGAAAAAGA<br>TAGGGTCTTTACCGATAAAACCAGCGCTACGGTTATCTGTCGGAAGAACGCTTCCA<br>TCTCCGTCCGCGCTCAGGATCGTTACTACTCGTCCTCATGGAGCGAGTGGGCCAGC<br>GTGCCCTGCAGCGGCGGCGGTGGAGGCGGATCCAGAAATCTGCCTGTTGCCACACC |

SUMMARY OF SEQUENCES

| SEQ ID NO | Description | Sequence |
|---|---|---|
| | | AGACCCTGGCATGTTCCCCTGTCTGCATCATAGCCAGAACCTGCTCAGAGCCGTGA<br>GCAACATGCTCCAGAAGGCCAGGCAAACTTTGGAGTTCTACCCGTGTACATCTGAG<br>GAAATCGATCACGAAGATATAACCAAAGATAAAACCTCTACAGTAGAGGCTTGTTT<br>GCCCCTGGAGTTGACCAAAAACGAGAGTTGCCTGAACAGTCGCGAGACGAGCTTCA<br>TTACTAACGGCAGCTGTCTCGCCTCCAGAAAAACATCCTTCATGATGGCCCTGTGT<br>CTTTCCAGCATATACGAAGACCTGAAAATGTACCAGGTCGAGTTCAAAACAATGAA<br>CGCCAAGCTGCTTATGGACCCCAAGCGGCAGATCTTCCTCGACCAAAACATGCTCG<br>CTGTGATCGATGAGCTGATGCAGGCTCTCAACTTCAATTCCGAAACAGTGCCACAG<br>AAGTCCAGTCTGGAAGAACCCGACTTCTACAAGACCAAGATTAAGCTGTGTATTTT<br>GCTGCATGCGTTTAGAATCAGAGCCGTGACCATTGATCGGGTGATGAGCTACCTGA<br>ACGCCTCGTGATAATAGGCTGGAGCCTCGGTGGCCATGCTTCTTGCCCCTTGGGCC<br>TCCCCCCAGCCCCTCCTCCCCTTCCTGCACCCGTACCCCCCAAACACCATTGTCAC<br>ACTCCAGTGGTCTTTGAATAAAGTCTGAGTGGGCGGC |
| 119 | hIL12AB_019<br>(5'UTR ORF<br>3'UTR) | TCAAGCTTTTGGACCCTCGTACAGAAGCTAATACGACTCACTATAGGGAAATAAGA<br>GAGAAAAGAAGAGTAAGAAGAAATATAAGAGCCACCATGTGCCACCAGCAGCTTGT<br>CATCTCCTGGTTTTCTCTTGTCTTCCTGGCCTCGCCGCTGGTGGCCATCTGGGAGC<br>TGAAGAAGACGTTTACGTAGTAGAGTTGGATTGGTACCCAGACGCACCTGGAGAA<br>ATGGTGGTTCTCACCTGTGACACTCCTGAAGAAGACGGTATCACCTGGACGCTGGA<br>CCAAAGCTCAGAAGTTCTTGGCAGTGGAAAAACGCTGACCATACAAGTAAAAGAAT<br>TTGGGGATGCTGGCCAGTACACGTGCCACAAAGGAGGAGAAGTTCTCAGCCACAGT<br>TTACTTCTTCTTCACAAGAAAGAAGATGGCATCTGGTCCACAGATATTTTAAAAGA<br>CCAGAAGGAGCCCAAGAACAAAACCTTCCTCCGCTGTGAGGCCAAGAACTACAGTG<br>GTCGTTTCACCTGCTGGTGGCTCACCACCATCTCCACTGACCTCACCTTCTCTGTA<br>AAAAGCAGCCGTGGTTCTTCTGACCCCCAAGGAGTCACCTGTGGGGCTGCCACGCT<br>CTCGGCAGAAAGAGTTCGAGGTGACAACAAGGAATATGAATATTCTGTGGAATGTC<br>AAGAAGATTCTGCCTGCCCGGCGGCAGAAGAAAGTCTTCCCATAGAAGTCATGGTG<br>GATGCTGTTCACAAATTAAAATATGAAAACTACACCAGCAGCTTCTTCATTCGTGA<br>CATCATCAAACCAGACCCGCCCAAGAACCTTCAGTTAAAACCTTTAAAAAACAGCC<br>GGCAGGTAGAAGTTTCCTGGGAGTACCCAGATACGTGGTCCACGCCGCACTCCTAC<br>TTCAGTTTAACCTTCTGTGTACAAGTACAAGGAAAATCAAAAAGAGAGAAGAAAGA<br>TCGTGTCTTCACTGACAAAACATCTGCCACGGTCATCTGCAGGAAGAATGCCTCCA<br>TCTCGGTTCGAGCCCAGGACCGCTACTACAGCAGCAGCTGGAGTGAGTGGGCATCT<br>GTTCCCTGCAGTGGTGGCGGCGGCGGCAGCCGCAACCTTCCTGTGGCCACGCC<br>GGACCCTGGCATGTTCCCGTGCCTTCACCACTCCCAAAATCTTCTTCGTGCTGTTT<br>CTAACATGCTGCAGAAGGCGCGCAAACTTTAGAATTCTACCCGTGCACTTCTGAA<br>GAAATAGACCATGAAGATATCACCAAAGATAAAACCAGCACGGTGGAGGCCTGCCT<br>TCCTTTAGAGCTGACCAAGAATGAATCCTGCCTCAACAGCAGAGAGACCAGCTTCA<br>TCACCAATGGCAGCTGCCTGGCCTCGCGCAAGACCAGCTTCATGATGGCGCTGTGC<br>CTTTCTTCCATCTATGAAGATTTAAAGATGTACCAAGTAGAATTTAAAACCATGAA<br>TGCCAAATTATTAATGGACCCCAAACGGCAGATATTTTTGGATCAAAACATGCTGG<br>CTGTCATTGATGAGCTCATGCAAGCATTAAACTTCAACTCAGAAACTGTTCCCCAG<br>AAGTCATCTTTAGAAGAGCCAGATTTCTACAAAACAAAAATAAAACTCTGCATTCT<br>TCTTCATGCCTTCCGCATCCGTGCTGTCACCATTGACCGTGTCATGTCCTACTTAA<br>ATGCTTCTTGATAATAGGCTGGAGCCTCGGTGGCCATGCTTCTTGCCCCTTGGGCC<br>TCCCCCCAGCCCCTCCTCCCCTTCCTGCACCCGTACCCCCCAAACACCATTGTCAC<br>ACTCCAGTGGTCTTTGAATAAAGTCTGAGTGGGCGGC |
| 120 | hIL12AB_020<br>(5'UTR ORF<br>3'UTR) | TCAAGCTTTTGGACCCTCGTACAGAAGCTAATACGACTCACTATAGGGAAATAAGA<br>GAGAAAAGAAGAGTAAGAAGAAATATAAGAGCCACCATGTGCCACCAGCAGCTGGT<br>GATCAGCTGGTTCAGCCTGGTGTTCCTGGCTAGCCCTCTGGTGGCCATCTGGGAGC<br>TGAAGAAGGACGTGTACGTGGTGGAGTTGGATTGGTACCCCGACGCTCCCGGCGAG<br>ATGGTGGTGCTGACCTGCGACACCCCCGAGGAGGACGGGATCACCTGGACCCTGGA<br>TCAGTCAAGCGAGGTGCTGGAAGCGGCAAGACCCTGACCATCCAGGTGAAGGAGT<br>TCGGCGACGCCGGCCAATACACTTGCCACAAGGGAGGCGAGGTGCTGTCCCACTCC<br>CTCCTGCTGCTGCACAAAAAGGAAGACGGCATCTGGAGCACCGACATCCTGAAAGA<br>CCAGAAGGAGCCTAAGAACAAAACATTCCTCAGATGCGAGGCCAAGAATTACTCCG<br>GGAGATTCACCTGTTGGTGGCTGACCACCATCAGCACAGACCTGACCTTCAGCGTG<br>AAGAGCAGCAGAGGCAGCAGCGACCCCCAGGGCGTGACCTGTGGCGCCGCCACCCT<br>GAGCGCCGAAAGAGTGCGCGGCGACAACAAGGAGTACGAGTACTCCGTGGAATGCC<br>AGGAAGATAGCGCCTGCCCCGCCGCCGAGGAGACCTGCCCATCGAGGTGATGGTG<br>GACGCCGTCCACAAGCTGAAGTACGAGAACTACACCTCTAGCTTCTTCATCAGAGA<br>TATCATCAAGCCCGATCCCCCAAGAACCTGCAGCTGAAACCCCTGAAGAACAGCC<br>GGCAGGTGGAGGTGAGCTGGGAGTATCCCGACACCTGGTCCACCCCCCACAGCTAT<br>TTTAGCCTGACCTTCTGCGTGCAAGTGCAGGGCAAGAGCAAGAGAGAGAAGAAGGA<br>CCGCGTGTTCACCGACAAAACCAGCGCCACCGTGATCTGCAGAAAGAACGCCAGCA<br>TCAGCGTGAGGGCCCAGGATAGATACTACAGTTCCAGCTGGAGCGAGTGGGCCAGC<br>GTGCCCTGCAGCGGCGGCGGCGGGGAGGCTCGAGAAACCTGCCCGTGGCTACCCC<br>CGATCCCGGAATGTTCCCTGCCTGCACCACAGCCAGAACCTGCTGAGGGCGGTGT<br>CCAACATGCTTCAGAAGGCCCGGCAGACCCTGGAGTTCTACCCCTGTACCTCTGAG<br>GAGATCGATCATGAAGATATCACAAAAGATAAAACCAGCACCGTGGAGGCCTGCCT<br>GCCCCTGGAGCTGACCAAGAACGAGAGCTGCCTGAACTCCCGCGAGACCAGCTTCA<br>TCACGAACGGCAGCTGCCTGGCCAGCAGGAAGACCTCCTTCATGATGGCCCTGTGC |

SUMMARY OF SEQUENCES

| SEQ ID NO | Description | Sequence |
|---|---|---|
| | | CTGAGCAGCATCTACGAGGACCTGAAAATGTACCAGGTGGAGTTTAAGACCATGAACGCCAAGCTGCTGATGGACCCCAAGCGGCAAATCTTCCTGGACCAGAACATGCTGGCAGTGATCGACGAGCTCATGCAGGCCCTGAACTTCAATAGCGAGACGGTCCCCCAGAAGAGCAGCCTGGAGGAGCCCGACTTTTACAAGACCAAGATCAAGCTGTGCATCCTGCTGCACGCCTTTAGAATCCGTGCCGTGACCATTGACAGAGTGATGAGCTACCTGAATGCCAGCTGATAATAGGCTGGAGCCTCGGTGGCCATGCTTCTTGCCCCTTGGGCCTCCCCCCAGCCCTCCTCCCCTTCCTGCACCCGTACCCCCCAAACACCATTGTCACACTCCAGTGGTCTTTGAATAAAGTCTGAGTGGGCGGC |
| 121 | hIL12AB_021 (5'UTR ORF 3'UTR) | TCAAGCTTTTGGACCCTCGTACAGAAGCTAATACGACTCACTATAGGGAAATAAGAGAGAAAAGAAGAGTAAGAAGAAATATAAGAGCCACCATGTGCCACCAGCAGCTGGTGATCAGCTGGTTCAGCCTGGTGTTCCTGGCCAGCCCTCTGGTTGCCATCTGGGAGCTGAAGAAAGACGTGTACGTCGTGGAACTGGACTGGTATCCGGACGCCCCGGGCGAGATGGTGGTGCTGACCTGTGACACCCCCGAGGAGGACGGCATCACCTGGACGCTGGACCAATCCTCCGAGGTGCTGGGAAGCGGCAAGACCCTGACCATCCAGGTGAAGGAATTCGGGGACGCCGGGCAGTACACCTGCCACAAGGGGGGCGAAGTGCTGTCCCACTCGCTGCTGCTCCTGCATAAGAAGGAGGATGGAATCTGGTCCACCGACATCCTCAAAGATCAGAAGGAGCCCAAGAACAAGACGTTCCTGCGCTGTGAAGCCAAGAATTATTCGGGGCGATTCACGTGCTGGTGGCTGACAACCATCAGCACCGACCTGACGTTTAGCGTGAAGAGCAGCAGGGGGTCCAGCGACCCCCAGGGCGTGACGTGCGGCGCCGCCACCCTCTCCGCCGAGAGGGTGCGGGGGGACAATAAGGAGTACGAGTACAGCGTGGAATGCCAGGAGGACAGCGCCTGCCCCGCCGCGGAGGAAAGCCTCCCGATAGAGGTGATGGTGGACGCCGTGCACAAGCTCAAGTATGAGAATTACACCAGCAGCTTTTTCATCCGGGACATTATCAAGCCCGACCCCCCGAAGAACCTCCAGCTGAAGCCCCTGAAGAACAGCCGGCAGGTGGAAGTCTCCTGGGAGTATCCCGACACCTGGAGCACCCCGCACAGCTACTTCTCCCTGACCTTCTGTGTGCAGGTGCAGGGCAAGTCCAAGAGGGAAAAGAAGGACAGGGTTTTCACCGACAAGACCAGCGCGACCGTGATCTGCCGGAAGAACGCCAGCATAAGCGTCCGCGCCCAAGATAGGTACTACAGCAGCTCCTGGAGCGAGTGGGCTAGCGTGCCCTGCAGCGGGGGCGGGGGTGGGGGCTCCAGGAACCTGCCAGTGGCGACCCCCGACCCCGGCATGTTCCCCTGCCTCCATCACAGCCAGAACCTGCTGAGGGCCGTCAGCAAATATGCTGCAGAAGGCCAGGCAGACCCTGGAATTCTACCCCTGCACGTCGGAGGAGATCGATCACGAGGATATCACAAAAGACAAGACTTCCACCGTGGAGGCCTGCCTGCCCCTGGAGCTCACCAAGAATGAGTCCTGTCTGAACTCCCGGGAAACCAGCTTCATCACCAACGGGTCCTGCCTGGCCAGCAGGAAGACCAGCTTTATGATGGCCCTGTGCCTGTCGAGCATCTACGAGGACCTGAAGATGTACCAGGTCGAGTTCAAGACAATGAACGCCAAGCTGCTGATGGACCCCAAGAGGCAAATCTTCCTGGACCAGAATATGCTTCCGTCATCGACGAGCTCATGCAGGCCCTGAACTTCAACTCCGAGACCGTGCCCCAGAAGAGCAGCCTGGAGGAGCCCGACTTCTACAAGACCAAGATCAAGCTGTGCATCCTGCTGCACGCGTTCAGGATCCGGGCAGTCACCATCGACCGTGTGATGTCCTACCTGAACGCCAGCTGATAATAGGCTGGAGCCTCGGTGGCCATGCTTCTTGCCCCTTGGGCCTCCCCCCAGCCCTCCTCCCCTTCCTGCACCCGTACCCCCCAAACACCATTGTCACACTCCAGTGGTCTTTGAATAAAGTCTGAGTGGGCGGC |
| 122 | hIL12AB_022 (5'UTR ORF 3'UTR) | TCAAGCTTTTGGACCCTCGTACAGAAGCTAATACGACTCACTATAGGGAAATAAGAGAGAAAAGAAGAGTAAGAAGAAATATAAGAGCCACCATGTGCCATCAGCAGCTGGTGATCAGCTGGTTCAGCCTGGTGTTCCTCGCCTCTCCCCTGGTGGCCATCTGGGAGCTCAAAAAGGACGTGTACGTGGTGGAGCTCGACTGGTACCCAGACGCCCCCGGGGAGATGGTGGTGCTGACCTGCGACACCCCCGAAGAAGACGGCATCACGTGGACCCTCGACCAGTCCAGCGAGGTGCTGGGGAGCGGGAAGACTCTGACCATCCAGGTCAAGGAGTTCGGGGACGCCGGGCAGTACACGTGCCACAAGGGCGGCGAAGTCTTAAGCCACAGCCTGCTCCTGCTGCACAAGAAGGAGGACGGGATCTGGTCCACAGACATACTGAAGGACCAGAAGGAGCCGAAGAATAAAACCTTTCTGAGGTGCGAGGCCAAGAACTATTCCGGCAGGTTCACGTGCTGGTGGCTTACAACAATCAGCACAGACCTGACGTTCAGCGTGAAGTCCAGCCGCGGCAGCAGCGACCCCCAGGGGGTGACCTGCGGCGCCGCCACCCTGAGCGCCGAGCGGGTGCGCGGGGACAACAAGGAGTACGAGTACTCCGTGGAGTGCCAGGAAGACAGCGCCTGTCCCGCCGCCGAAGAGAGCCTGCCTATCGAGGTCATGGTAGATGCAGTGCATAAGCTGAAGTACGAGAACTATACGAGCAGCTTTTTCATACGCGACATCATCAAGCCCGACCCCCCCAAGAACCTGCAGCTTAAGCCCCTGAAGAATAGCCGGCAGGTGGAGGTCTCCTGGGAGTACCCCGACACCTGGTCAACGCCCCACAGCTACTTCTCCCTGACCTTTTGTGTCCAAGTCCAGGGAAAGAGCAAGAGGGAGAAGAAATCGGGTGTTCACCGACAAGACCTCCGCCACGGTGATCTGCAGGAAGAACGCCAGCATCTCCGTGAGGGCGCAAGACAGGTACTACTCCAGCAGCTGGTCCGAATGGGCCAGCGTGCCCTGCTCCGGCGGCGGGGCGGCGGCAGCCGAAACCTACCCGTGGCCACGCCGGATCCCGGCATGTTCCCCTGCCTGCACCACAGCCAGAACCTCCTGAGGGCCGTGTCCAACATGCTGCAGAAGGCCAGGCAGACTCTGGAGTTCTACCCCTGCACGAGCGAGGAGATCGATCACGAGGACATCACCAAGGATAAGACCAGCACTGTGGAGGCCTGCCTTCCCCTGGAGCTGACCAAGAACGAGAGCTGTCTGAACTCCAGGGAGACCTCATTCATCACCAACGGCTCCTGCCTGGCCAGCAGGAAAACCAGCTTCATGATGGCCTTGTGTCTCAGCTCCATCTACGAGGACCTGAAGATGTATCAGGTCGAGTTCAAGACAATGAACGCCAAGCTGCTGATGGACCCCAAAAGGCAGATCTTCCTGGACCAGAACATGCTGGCCGTCATCGACGAGCTGATGCAGGCCCTGAACTTCAACAGCGAGACGGTGCCCCAGAAAAGCTCCCTGGAGGAGCCCGACTTCTACAAGACCAAGATCAAGCTGTGCATCCTGCTGCACGCCTTCAGGATCAGGGCAGTGACCATCGACCGGGTGATGTCATACCTTA |

SUMMARY OF SEQUENCES

| SEQ ID NO | Description | Sequence |
|---|---|---|
| | | ACGCCAGCTGATAATAGGCTGGAGCCTCGGTGGCCATGCTTCTTGCCCCTTGGGCC TCCCCCCAGCCCCTCCTCCCCTTCCTGCACCCGTACCCCCCAAACACCATTGTCAC ACTCCAGTGGTCTTTGAATAAAGTCTGAGTGGGCGGC |
| 123 | hIL12AB_023 (5'UTR ORF 3'UTR) | TCAAGCTTTTGGACCCTCGTACAGAAGCTAATACGACTCACTATAGGGAAATAAGA GAGAAAAGAAGAGTAAGAAGAAATATAAGAGCCACCATGTGCCATCAGCAGCTGGT GATCTCCTGGTTCAGCCTGGTGTTTCTGGCCTCGCCCCTGGTCGCCATCTGGGAGC TGAAGAAAGACGTGTACGTCGTCGAACTGGACTGGTACCCCGACGCCCCCGGGGAG ATGGTGGTGCTGACCTGCGACACGCCGGAGGAGGACGGCATCACCTGGACCCTGGA TCAAAGCAGCGAGGTGCTGGGCAGCGGCAAGACCCTGACCATCCAAGTGAAGGAAT TCGGCGATGCCGGCCAGTACACCTGTCACAAAGGGGGCGAGGTGCTCAGCCACAGC CTGCTGCTGCTGCACAAGAAGGAGGATGGCATCTGGAGCACCGATATCCTGAAGGA CCAGAAAGAGCCCAAGAACAAGACGTTCCTGAGGTGCGAGGCCAAGAACTACAGCG GTAGGTTCACGTGTTGGTGGCTGACCACCATCAGCACCGACCTGACGTTCAGCGTG AAGAGCTCCAGGGGCAGCTCCGACCCACAGGGGGTGACGTGCGGGGCCGCAACCCT CAGCGCCGAAAGGGTGCGGGGGGACAACAAGGAGTACGAATACTCCGTGGAGTGCC AGGAAGATTCGGCCTGCCCCGCCGCGGAGGAGAGCCTCCCCATCGAGGTAATGGTG GACGCCGTGCATAAGCTGAAGTACGAGAACTACACCAGCTCGTTCTTCATCCGAGA CATCATCAAACCCGACCCGCCCAAAAATCTGCAGCTCAAGCCCCTGAAGAACTCCA GGCAGGTGGAGGTGAGCTGGGAGTACCCCGACACCTGGTCCACCCCGCACAGCTAC TTCTCCCTGACATTCTGCGTGCAGGTGCAGGGCAAGAGCAAGCGGGAGAAGAAGGA CAGGGTGTTCACCGACAAGACGAGCGCCACCGTGATCTGCCGAAAGAACGCCAGCA TCTCGGTGCGCGCCCAGGATAGGTACTATTCCAGCTCCTGGAGCGAGTGGGCCTCG GTACCCTGCAGCGGCGGCGGGGGCGGCGGCAGTAGGAATCTGCCCGTGGCTACCCC GGACCCGGGCATGTTCCCCTGCCTCCACCACAGCCAGAACCTGCTGAGGGCCGTGA GCAACATGCTGCAGAAGGCCAGACAGACGCTGGAGTTCTACCCCTGCACGAGCGAG GAGATCGACCACGAGGACATCACCAAGGATAAAACTTCCACCGTCGAGGCCTGCCT GCCCTTGGAGCTGACCAAGAATGAATCCTGTCTGAACAGCAGGGAGACCTCGTTTA TCACCAATGGCAGCTGCCTGCCTCCAGGAAGACCAGCTTCATGATGGCCCTCTGT CTGAGCTCCATCTATGAGGACCTGAAGATGTACCAGGTGGAGTTCAAGACCATGAA CGCGAAGCTGCTGATGGACCCCAAGAGGCAGATCTTCCTGGATCAGAATATGCTGG CGGTGATCGACGAGCTCATGCAGGCCCTCAATTTCAATAGCGAGACAGTGCCCCAG AAGTCCTCCCTGGAGGAGCCCGACTTCTACAAGACCAAGATCAAGCTGTGTATCCT GCTGCACGCCTTCCGGATCCGGGCCGTCACCATCGACCGGGTCATGAGCTACCTCA ATGCCAGCTGATAATAGGCTGGAGCCTCGGTGGCCATGCTTCTTGCCCCTTGGGCC TCCCCCCAGCCCCTCCTCCCCTTCCTGCACCCGTACCCCCCAAACACCATTGTCAC ACTCCAGTGGTCTTTGAATAAAGTCTGAGTGGGCGGC |
| 124 | hIL12AB_024 (5'UTR ORF 3'UTR) | TCAAGCTTTTGGACCCTCGTACAGAAGCTAATACGACTCACTATAGGGAAATAAGA GAGAAAAGAAGAGTAAGAAGAAATATAAGAGCCACCATGTGCCACCAGCAGCTGGT GATCTCCTGGTTCTCCCTGGTGTTCCTGGCCTCGCCCCTGGTGGCCATCTGGGAGC TGAAGAAGGACGTGTACGTCGTGGAGCTCGACTGGTACCCCGACGCCCCTGGCGAG ATGGTGGTGCTGACCTGCGACACCCCAGAGGAGGATGGCATCACCTGGACCCTGGA TCAGTCCTCCGAGGTGCTGGGCTCCGGCAAGACGCTGACCATCCAAGTGAAGGAGT TCGGTGACGCCGGACAGTATACCTGCCATAAGGGCGGCGAGGTCCTGTCCCACAGC CTCCTCCTCCTGCATAAGAAGGAGGACGGCATCTGGAGCACCGACATCCTGAAGGA CCAGAAGGAGCCCAAGAACAAGACCTTTCTGAGGTGCGAGGCCAAGAACTACAGCG GCCGATTCACCTGCTGGTGGCTCACCACCATATCCACCGACCTGACTTTCTCCGTC AAGTCCTCCCGGGGGTCCAGCGACCCCCAGGGAGTGACCTGCGGCGCCGCCACCCT CAGCGCCGAGCGGGTGCGGGGGGACAACAAGGAGTACGAATACTCCGTCGAGTGCC AGGAGGACTCCGCCTGCCCGGCCGCCGAGGAGAGCCTGCCCATCGAGGTGATGGTC GACGCCGTGCACAAGCTGAAGTACGAGAACTACACCAGCAGTTTCTTCATCAGGGA TATCATCAAGCCAGATCCCCGAAGAATCTGCAACTGAAGCCGCTGAAAAACTCAC GACAGGTGGAGGTGAGCTGGGAGTACCCCGACACGTGGAGCACCCCACATTCCTAC TTCAGCCTGACCTTCTGCGTGCAGGTCCAGGGCAAGAGCAAGCGGGAGAAGAAGGA CAGGGTGTTCACGGATAAGACCAGTGCCACCGTGATCTGCAGGAAGAACGCCTCTA TTAGCGTGAGGGCCCAGGATCGGTATTACTCCTCGAGCTGGAGCGAATGGGCCTCC GTGCCCTGCAGTGGGGGGGGTGGAGGCGGGAGCAGGAACCTGCCCGTAGCAACCCC CGACCCCGGGATGTTCCCCTGTCTGCACCACTCGCAGAACCTGCTGCGCGCGGTGA GCAACATGCTCCAAAAGCCCGTCAGACCTTAGAGTTCTACCCCTGCACCAGCGAA GAAATCGACCACGAAGACATCACCAAGGACAAAACCAGCACCGTGGAGGCGTGCCT GCCGCTGGAGCTGACCAAGAACGAGAGCTGCCTCAACTCCAGGGAGACCAGCTTTA TCACCAACGGCTCGTGCCTAGCCAGCCGGAAAACCAGCTTCATGATGGCCCTGTGC CTGAGCTCCATTTACGAGGACCTGAAGATGTATCAGGTGGAGTTCAAGACCATGAA TGCCAAACTCCTGATGGACCCCAAGAGGCAGATCTTCCTGGACCAGAACATGCTCG CGGTGATCGATGAGCTGATGCAGGCCCTGAACTTTAATAGCGAGACCGTGCCCCAG AAAAGCAGCCTGGAGGAGCCGGACTTCTACAAGACCAAAATCAAGCTGTGCATCCT GCTCCACGCCTTCCGCATCCGGGCCGTGACCATCGACAGGGTGATGAGCTACCTGA ACGCCAGCTGATAATAGGCTGGAGCCTCGGTGGCCATGCTTCTTGCCCCTTGGGCC TCCCCCCAGCCCCTCCTCCCCTTCCTGCACCCGTACCCCCCAAACACCATTGTCAC ACTCCAGTGGTCTTTGAATAAAGTCTGAGTGGGCGGC |

SUMMARY OF SEQUENCES

| SEQ ID NO | Description | Sequence |
|---|---|---|
| 125 | hIL12AB_025 (5'UTR ORF 3'UTR) | TCAAGCTTTTGGACCCTCGTACAGAAGCTAATACGACTCACTATAGGGAAATAAGA<br>GAGAAAAGAAGAGTAAGAAGAAATATAAGAGCCACCATGTGCCATCAGCAGCTGGT<br>GATTTCCTGGTTCTCCCTGGTGTTCCTGGCCAGCCCCTCGTGGCCGATCTGGGAGC<br>TAAAGAAGGACGTGTACGTGGTGGAGCTGGACTGGTACCCGGACGCACCCGGCGAG<br>ATGGTCGTTCTGACCTGCGATACGCCAGAGGAGGACGGCATCACCTGGACCCTCGA<br>TCAGAGCAGCGAGGTCCTGGGGAGCGGAAAGACCCTGACCATCCAGGTCAAGGAGT<br>TCGGCGACGCCGGCCAGTACACCTGCCACAAAGGTGGCGAGGTCCTGAGCCACTCG<br>CTGCTGCTCCTGCATAAGAAGGAGGACGGAATCTGGAGCACAGACATCCTGAAAGA<br>CCAGAAGGAGCCCAAGAACAAGACCTTCCTGAGGTGCGAGGCCAAGAACTACAGCG<br>GGCGCTTCACGTGCTGGTGGCTGACCACCATCAGCACGGACCTCACCTTCTCCGTG<br>AAGAGCAGCCGGGGATCCAGCGATCCCCAAGGCGTCACCTGCGGCGCGGCCACCCT<br>GAGCGCGGAGAGGGTCAGGGGCGATAATAAGGAGTATGAGTACAGCGTGGAGTGCC<br>AGGAGGACAGCGCCTGCCCGGCCGCCGAGGAGTCCCTGCCAATCGAAGTGATGGTC<br>GACGCCGTGCACAAGCTGAAGTACGAGAACTACACCAGCAGCTTCTTCATCCGGGA<br>TATCATCAAGCCCGATCCCCCGAAGAACCTGCAGCTGAAGCCCCTCAAGAACAGCC<br>GGCAGGTGGAGGTGAGTTGGGAGTACCCCGACACCTGGTCAACGCCCCACAGCTAC<br>TTCTCCCTGACCTTCTGTGTGCAGGTGCAGGGAAAGAGCAAGAGGGAGAAGAAAGA<br>CCGGGTCTTCACCGACAAGACCAGCGCCACGGTGATCTGCAGGAAGAACGCAAGCA<br>TCTCCGTGAGGGCCCAGGACAGGTACTACAGCTCCAGCTGGTCCGAATGGGCCAGC<br>GTGCCCTGTAGCGGCGGCGGGGGCGGTGGCAGCCGCAACCTCCCAGTGGCCACCCC<br>CGACCCCGGCATGTTCCCCTGCCTGCACCACAGCCAGAATCTGCTGAGGGCCGTGA<br>GTAACATGCTGCAGAAGGCAAGGCAAACCCTCGAATTCTATCCCTGCACCTCCGAG<br>GAGATCGACCACGAGGATATCACCAAGGACAAGACCAGCACCGTCGAGGCCTGTCT<br>CCCCCTGGAGCTGACCAAGAATGAGAGCTGCCTGAACAGCCGGGAGACCAGCTTCA<br>TCACCAACGGGAGCTGCCTGGCCTCCAGGAAGACCTCGTTCATGATGGCGCTGTGC<br>CTCTCAAGCATATACGAGGATCTGAAGATGTACCAGGTGGAGTTTAAGACGATGAA<br>CGCCAAGCTGCTGATGGACCCGAAGAGGCAGATCTTCCTGGACCAGAACATGCTGG<br>CCGTGATAGACGAGCTCATGCAGGCCCTGAACTTCAACTCCGAGACCGTGCCGCAG<br>AAGTCATCCCTCGAGGAGCCCGACTTCTATAAGACCAAGATCAAGCTGTGCATCCT<br>GCTCCACGCCTTCCGGATAAGGGCCGTGACGATCGACAGGGTGATGAGCTACCTTA<br>ACGCCAGCTGATAATAGGCTGGAGCCTCGGTGGCCATGCTTCTTGCCCCTTGGGCC<br>TCCCCCCAGCCCCTCCTCCCCTTCCTGCACCCGTACCCCCCAAACACCATTGTCAC<br>ACTCCAGTGGTCTTTGAATAAAGTCTGAGTGGGCGGC |
| 126 | hIL12AB_026 (5'UTR ORF 3'UTR) | TCAAGCTTTTGGACCCTCGTACAGAAGCTAATACGACTCACTATAGGGAAATAAGA<br>GAGAAAAGAAGAGTAAGAAGAAATATAAGAGCCACCATGTGCCACCAGCAGCTCGT<br>GATCAGCTGGTTCTCCCTGGTGTTTCTCGCCAGCCCCTCTGGTGGCCATCTGGGAGC<br>TGAAGAAGGACGTGTACGTGGTGGAGCTGGACTGGTACCCTGACGCCCCGGGGGAG<br>ATGGTCGTGCTGACCTGCGACACCCCCGAAGAGGACGGTATCACCTGGACCCTGGA<br>CCAGTCCAGCGAGGTGCTGGGCAGCGGCAAGACCCTGACTATTCAAGTCAAGGAGT<br>TCGGAGACGCCGGCCAGTACACCTGCCACAAGGGTGGAGAGGTGTTATCACACAGC<br>CTGCTGCTGCTGCACAAGAAGGAAGACGGGATCTGGAGCACCGACATCCTGAAGGA<br>CCAGAAGGAGCCCAAAAACAAGACCTTCCTGCGGTGCGAGGCCAAGAACTATTCGG<br>GCCGCTTTACGTGCTGGTGGCTGACCACCATCAGCACTGATCTCACCTTCAGCGTG<br>AAGTCCTCCCGGGGGTCGTCCGACCCCCAGGGGGTGACCTGCGGGGCCGCCACCCT<br>GTCCGCCGAGAGAGTGAGGGGCGATAATAAGGAGTACGAGTACAGCGTTGAGTGCC<br>AGGAAGATAGCGCCTGTCCCGCCGCCGAGGAGACCCTGCCCATCGAGGTGATGGTG<br>GACGCCGTCCACAAGCTGAAGTATGAGAACTACACCTCAAGCTTCTTCATCAGGGA<br>CATCATCAAACCCGATCCGCCCAAGAATCTGCAGCTGAAGCCCCTGAAAAATAGCA<br>GGCAGGTGGAGGTGAGCTGGGAGTACCCCGACACCTGGTCCACCCCCCATAGCTAT<br>TTCTCCCTGACGTTCTGCGTGCAGGTGCAAGGGAAGAGCAAGCGGGAGAAGAAGGA<br>CCGGGTGTTCACCGACAAGACCTCCGCCACCGTGATCTGTAGGAAGAACGCGTCGA<br>TCTCGGTCAGGGCCCAGGACAGGTATTACAGCAGCAGCTGGAGCGAGTGGGCGAGC<br>GTGCCCTGCTCGGGCGGCGGCGGCGGGGAGCAGAAATCTGCCCGTGGCCACCCC<br>AGACCCCGGAATGTTCCCCTGCCTGCACCATTCGCAGAACCTCCTGAGGGCCGTGA<br>GCAACATGCTGCAGAAGGCCCGCCAGACGCTGGAGTTCTACCCCTGCACGAGCGAG<br>GAGATCGACCACGAAGACATCACCAAGGACAAAACCAGCACCGTGGAGGCCTGCCT<br>GCCCCTGGAGCTGACCAAAAACGAATCCTGCCTCAACAGCCGGGAGACCAGCTTCA<br>TCACCAACGGCAGCTGCCTGGCCAGCCGAAAGACCTCCTTCATGATGGCCCTCTGC<br>CTGAGCAGCATCTATGAGGATCTGAAGATGTATCAGGTGGAGTTCAAGACCATGAA<br>TGCCAAGCTGCTGATGGACCCCAAGAGGCAGATATTCCTGGACCAGAATATGCTGG<br>CCGTGATCGACGAGCTGATGCAGGCCCTGAACTTCAACAGCGAGACCGTCCCCCAG<br>AAGTCCAGCCTGGAGGAGCCGGACTTTTACAAAACGAAGATCAAGCTGTGCATACT<br>GCTGCACGCCTTCAGGATCCGGGCCGTGACAATCGACAGGGTGATGTCCTACCTGA<br>ACGCCAGCTGATAATAGGCTGGAGCCTCGGTGGCCATGCTTCTTGCCCCTTGGGCC<br>TCCCCCCAGCCCCTCCTCCCCTTCCTGCACCCGTACCCCCCAAACACCATTGTCAC<br>ACTCCAGTGGTCTTTGAATAAAGTCTGAGTGGGCGGC |
| 127 | hIL12AB_027 (5'UTR ORF 3'UTR) | TCAAGCTTTTGGACCCTCGTACAGAAGCTAATACGACTCACTATAGGGAAATAAGA<br>GAGAAAAGAAGAGTAAGAAGAAATATAAGAGCCACCATGTGTCACCAGCAGCTGGT<br>GATCAGCTGGTTCTCCCTGGTGTTCCTGGCCAGCCCCCTGGTGGCCATCTGGGAGC<br>TCAAGAAGGACGTCTACGTCGTGGAGCTGGATTGGTACCCCGACGCTCCCGGGGAG<br>ATGGTGGTGCTGACCTGCGACACCCCCGAGGAGGACGGCATCACCTGGACGCTGGA |

SUMMARY OF SEQUENCES

| SEQ ID NO | Description | Sequence |
|---|---|---|
| | | CCAGAGCTCAGAGGTGCTGGGAAGCGGAAAGACACTGACCATCCAGGTGAAGGAGT<br>TCGGGGATGCCGGGCAGTATACCTGCCACAAGGGCGGCGAAGTGCTGAGCCATTCC<br>CTGCTGCTGCTGCACAAGAAGGAGGACGGCATATGGTCCACCGACATCCTGAAGGA<br>TCAGAAGGAGCCGAAGAATAAAACCTTCCTGAGGTGCGAGGCCAAGAATTACAGCG<br>GCCGATTCACCTGCTGGTGGCTGACCACCATCAGCACCGACCTGACCTTCAGTGTG<br>AAGTCCTCACGGGCAGCTCAGATCCCCAGGGCGTGACCTGCGGGGCCGCGACACT<br>CAGCGCCGAGCGGGTGAGGGGTGATAACAAGGAGTACGAGTATTCTGTGGAGTGCC<br>AGGAAGACTCCGCCTGTCCCGCCGCCGAGGAGTCCCTGCCCATCGAGGTGATGGTG<br>GACGCCGTGCATAAACTGAAGTACGAGAACTACACCTCCAGCTTCTTCATCCGGGA<br>TATAATCAAGCCCGACCCTCCGAAAAACCTGCAGCTGAAGCCCCTTAAAAACAGCC<br>GGCAGGTGGAGGTGAGCTGGGAGTACCCCGACACCTGGAGCACCCCCCATAGCTAT<br>TTCAGCCTGACCTTCTGCGTGCAGGTGCAGGGGAAGTCCAAGCGCGAGAAAAAGGA<br>CCGGGTGTTCACCGACAAGACGAGCGCCACCGTGATCTGCCGGAAGAACGCCAGTA<br>TAAGCGTAAGGGCCCAGGATAGGTACTACAGCTCCAGCTGGTCGGAGTGGGCCTCC<br>GTGCCCTGTTCCGGCGGCGGGGGGGTGGCAGCAGGAACCTCCCCGTGGCCACGCC<br>GGACCCCGGCATGTTCCCGTGCCTGCACCACTCCCAAAACCTCCTGCGGGCCGTCA<br>GCAACATGCTGCAAAAGGCGCGGCAGACCCTGGAGTTTTACCCCTGTACCTCCGAA<br>GAGATCGACCACGAGGATATCACCAAGGATAAGACCTCCACCGTGGAGGCCTGTCT<br>CCCCCTGGAGCTGACCAAGAACGAGAGCTGTCTTAACAGCAGAGAGACCTCGTTCA<br>TAACGAACGGCTCCTGCCTCGCTTCCAGGAAGACGTTCATGATGGCGCTGTGC<br>CTGTCCAGCATCTACGAGGACCTGAAGATGTATCAGGTCGAGTTCAAAACCATGAA<br>CGCCAAGCTGCTGATGGACCCCAAGAGGCAGATCTTCCTGGACCAGAACATGCTCG<br>CCGTGATCGACGAGCTGATGCAGGCCCTGAACTTCAACAGCGAAACCGTGCCCCAG<br>AAGTCAAGCCTGGAGGAGCCGGACTTCTATAAGACCAAGATCAAGCTGTGTATCCT<br>GCTACACGCTTTTCGTATCCGGGCCGTGACCATCGACAGGGTTATGTCGTACTTGA<br>ACGCCAGCTGATAATAGGCTGGAGCCTCGGTGGCCATGCTTCTTGCCCCTTGGGCC<br>TCCCCCCAGCCCCTCCTCCCCTTCCTGCACCCGTACCCCCCAAACACCATTGTCAC<br>ACTCCAGTGGTCTTTGAATAAAGTCTGAGTGGGCGGC |
| 128 | hIL12AB_028<br>(5'UTR ORF<br>3'UTR) | TCAAGCTTTTGGACCCTCGTACAGAAGCTAATACGACTCACTATAGGGAAATAAGA<br>GAGAAAAGAAGAGTAAGAAGAAATATAAGAGCCACCATGTGCCACCAACAGCTCGT<br>GATCAGCTGGTTCAGCCTGGTGTTCCTGGCCAGCCCGCTGGTGGCCATCTGGGAGC<br>TGAAGAAGGACGTGTACGTGGTGGAGCTGGACTGGTACCCCGACGCCCCCGGCGAG<br>ATGGTGGTCCTGACCTGCGACACGCCGGAAGAGGACGGCATCACCTGGACCCTGGA<br>TCAGTCCAGCGAGGTGCTGGGCTCCGGCAAGACCCTGACCATTCAGGTGAAGGAGT<br>TCGGCGACGCCGGTCAGTACACCTGCCACAAGGGCGGCGAGGTGCTGAGCCACAGC<br>CTACTGCTCCTGCACAAAAAGGAGGATGGAATCTGGTCCACCGACATCCTCAAGGA<br>CCAGAAGGAGCCGAAGAACAAGACGTTCCTCCGGTGCGAGGCCAAGAACTACAGCG<br>GCAGGTTTACCTGCTGGTGGCTGACCACCATCAGCACCGACCTGACATTTTCCGTG<br>AAGAGCAGCCGCGGCAGCAGCGATCCCCAGGGCGTGACCTGCGGGGCGGCCACCCT<br>GTCCGCCGAGCGTGTGAGGGGCGACAACAAGGAGTACGAGTACAGCGTGGAATGCC<br>AGGAGGACAGCGCCTGTCCCGCCGCCGAGGAGAGCCTGCCAATCGAGGTCATGGTG<br>GACGCCGTGCACAAGCTGAAGTACGAGAACTACACGAGCAGCTTCTTCATCAGGGA<br>CATCATCAAACCGGACCCGCCCAAGAACCTGCAGCTGAAACCCTTGAAAAACAGCA<br>GGCAGGTGGAAGTGTCTTGGGAGTACCCCGACACCTGGTCCACCCCCCACAGCTAC<br>TTTAGCCTGACCTTCTGTGTGCAGGTCCAGGGCAAGTCCAAGAGGGAGAAGAAGGA<br>CAGGGTGTTCACCGACAAAACCAGCGCCACCGTGATCTGCAGGAAGAACGCCTCCA<br>TCAGCGTGCGGGCCCAGGACAGGTATTACAGCTCGTCGTGGAGCGAGTGGGCCAGC<br>GTGCCCTGCTCCGGGGGAGGCGGCGGCGGAAGCCGGAATCTGCCCGTGGCCACCCC<br>CGATCCCGGCATGTTCCCGTGTCTGCACCACAGCCAGAACCTGCTGCGGGCCGTGA<br>GCAACATGCTGCAGAAGGCCCGCAAACCCTGGAGTTCTACCCCTGTACAAGCGAG<br>GAGATCGACCATGAGGACATTACCAAGGACAAGACCAGCACCGTGGAGGCCTGCCT<br>GCCCCTCGAGCTCACAAAGAACGAATCCTGCCTGAATAGCCGCGAGACCAGCTTTA<br>TCACGAACGGGTCCTGCCTCGCCAGCCGGAAGACAAGCTTCATGATGGCCCTGTGC<br>CTGAGCAGCATCTACGAGGACCTGAAAATGTACCAAGTGGAGTTCAAAACGATGAA<br>CGCCAAGCTGCTGATGGACCCCAAGCGCCAGATCTTCCTGGACCAGAACATGCTGG<br>CCGTCATCGACGAGCTCATGCAGGCCCTGAACTTCAACAGCGAGACCGTGCCCCAG<br>AAGAGCAGCCTGGAGGAGCCCGACTTCTACAAGACGAAGATCAAGCTCTGCATCCT<br>GCTGCACGCTTTCCGCATCCGCGCGGTGACCATCGACCGGGTGATGAGCTACCTCA<br>ACGCCAGTTGATAATAGGCTGGAGCCTCGGTGGCCATGCTTCTTGCCCCTTGGGCC<br>TCCCCCCAGCCCCTCCTCCCCTTCCTGCACCCGTACCCCCCAAACACCATTGTCAC<br>ACTCCAGTGGTCTTTGAATAAAGTCTGAGTGGGCGGC |
| 129 | hIL12AB_029<br>(5'UTR ORF<br>3'UTR) | TCAAGCTTTTGGACCCTCGTACAGAAGCTAATACGACTCACTATAGGGAAATAAGA<br>GAGAAAAGAAGAGTAAGAAGAAATATAAGAGCCACCATGTGCCACCAACAGCTGGT<br>GATCAGCTGGTTCAGCCTGGTGTTTCTGGCCTCCCCTCTGGTGGCCATCTGGGAGC<br>TGAAGAAGGACGTGTACGTGGTGGAGCTGGACTGGTACCCTGACGCCCCCGGCGAA<br>ATGGTGGTGCTGACGTGCGACACCCCCGAGGAGGATGGCATCACCTGGACCCTGGA<br>CCAAAGCAGCGAGGTCCTCGGAAGCGGCAAGACCCTCACTATCCAAGTGAAGGAGT<br>TCGGGGATGCGGGCCAGTACACCTGCCACAAGGGCGGCGAGGTGCTGTCTCATAGC<br>CTGCTGCTCCTGCATAAGAAGGAAGACGGCATCTGGAGCACCGACATACTGAAGGA<br>TCAGAAGGAGCCCAAGAACAAGACCTTCCTGAGGTGCGAGGCCAAGAACTACTCCG<br>GGCGCTTCACCTGTTGGTGGCTGACCACCATCTCCACCGACCTGACCTTCAGCGTG |

SUMMARY OF SEQUENCES

| SEQ ID NO | Description | Sequence |
|---|---|---|
| | | AAGAGCAGCAGGGGGAGCAGCGACCCCCAGGGGGTGACCTGCGGAGCCGCGACCTT<br>GTCGGCCGAGCGGGTGAGGGGCGACAATAAGGAGTACGAGTACTCGGTCGAATGCC<br>AGGAGGACTCCGCCTGCCCCGCCGCCGAGGAGTCCCTCCCCATCGAAGTGATGGTG<br>GACGCCGTCCACAAGCTGAAGTACGAGAACTACACCAGCAGCTTCTTCATACGGGA<br>TATCATCAAGCCCGACCCCCCGAAGAACCTGCAGCTGAAACCCTTGAAGAACTCCA<br>GGCAGGTGGAGGTGAGCTGGGAGTACCCCGACACCTGGTCCACCCCGCACTCATAC<br>TTCAGCCTGACCTTCTGTGTACAGGTCCAGGGCAAGAGCAAGAGGGAAAAGAAGGA<br>TAGGGTGTTCACCGACAAGACCTCCGCCACGGTGATCTGTCGGAAAAACGCCAGCA<br>TCTCCGTGCGGGCCCAGGACAGGTACTATTCCAGCAGCTGGAGCGAGTGGGCCTCC<br>GTCCCCTGCTCCGGCGGCGGTGGCGGGGGCAGCAGGAACCTCCCCGTGGCCACCCC<br>CGATCCCGGGATGTTCCCATGCCTGCACCACAGCCAAAACCTGCTGAGGGCCGTCT<br>CCAATATGCTGCAGAAGGCGAGGCAGACCCTGGAGTTCTACCCCTGTACCTCCGAG<br>GAGATCGACCACGAGGATATCACCAAGGACAAGACCTCCACGGTCGAGGCGTGCCT<br>GCCCCTGGAGCTCACGAAGAACGAGAGCTGCCTTAACTCCAGGGAAACCTCGTTTA<br>TCACGAACGGCAGCTGCCTGGCGTCACGGAAGACCTCCTTTATGATGGCCCTATGT<br>CTGTCCTCGATCTACGAGGACCTGAAGATGTACCAGGTGGAGTTCAAGACCATGAA<br>CGCCAAGCTGCTGATGGATCCCAAGAGGCAGATTTTCCTGGACCAGAACATGCTGG<br>CCGTGATTGACGAGCTGATGCAGGCGCTGAACTTCAACAGCGAGACAGTGCCGCAG<br>AAGAGCTCCCTGGAGGAGCCGGACTTTTACAAGACCAAGATAAAGCTGTGCATCCT<br>GCTCCACGCCTTCAGAATACGGGCCGTCACCATCGATAGGGTGATGTCTTACCTGA<br>ACGCCTCCTGATAATAGGCTGGAGCCTCGGTGGCCATGCTTCTTGCCCCTTGGGCC<br>TCCCCCCAGCCCTCCTCCCCTTCCTGCACCCGTACCCCCCAAACACCATTGTCAC<br>ACTCCAGTGGTCTTTGAATAAAGTCTGAGTGGGCGGC |
| 130 | hIL12AB_030 (5'UTR ORF 3'UTR) | TCAAGCTTTTGGACCCTCGTACAGAAGCTAATACGACTCACTATAGGGAAATAAGA<br>GAGAAAAGAAGAGTAAGAAGAAATATAAGAGCCACCATGTGCCACCAGCAGCTGGT<br>GATTAGCTGGTTTAGCCTGGTGTTCCTGGCAAGCCCCCTGGTGGCCATCTGGGAAC<br>TGAAAAAGGACGTGTACGTGGTCGAGCTGGATTGGTACCCCGACGCCCCCGGCGAA<br>ATGGTGGTGCTGACGTGTGATACCCCCGAGGAGGACGGGATCACCTGGACCCTGGA<br>TCAGAGCAGCGAGGTGCTGGGGAGCGGGAAGACCCTGACGATCCAGGTCAAGGAGT<br>TCGGCGACGCTGGGCAGTACACCTGTCACAAGGGCGGGGAGGTGCTGTCCCACTCC<br>CTGCTGCTCCTGCATAAGAAAGAGGACGGCATCTGGTCCACCGACATCCTCAAGGA<br>CCAGAAGGAGCCCAAGAACAAGACCTTCCTGCGGTGTGAGGCGAAGAACTACAGCG<br>GCCGTTTCACCTGCTGGTGGCTGACGACAATCAGCACCGACTTGACGTTCTCCGTG<br>AAGTCCTCCAGAGGCAGCTCCGACCCCCAAGGGGTGACGTGCGGCGCGGCCACCCT<br>GAGCGCCGAGCGGGTGCGGGGGACAACAAGGAGTACGAGTACTCCGTGGAGTGCC<br>AGGAGGACAGCGCCTGTCCCGCAGCCGAGGAGTCCCTGCCCATCGAAGTCATGGTC<br>GACGCCGTCCACAAGCTGAAGTACGAGAACTACACCAGCAGCTTCTTCATCCGCGA<br>TATCATCAAGCCCGATCCCCCCAAAAACCTGCAACTGAAGCCGCTGAAGAATAGCA<br>GGCAGGTGGAGGTGTCCTGGGAGTACCCCGACACCTGGAGCACGCCCCACAGCTAT<br>TTCAGCCTGACCTTTTGCGTGCAGGTCCAGGGGAAGAGCAAGCGGGAGAAGAAGGA<br>CCGCGTGTTTACGGACAAAACCAGCGCCACCGTGATCTGCAGGAAGAACGCCAGCA<br>TCAGCGTGAGGGCCCAGGACAGGTACTACAGCAGCTCCTGGAGCGAGTGGGCCTCC<br>GTGCCCTGTTCCGGAGGCGGCGGGGGCGGTTCCCGGAACCTCCCGGTGGCCACCCC<br>CGACCCGGGCATGTTCCCGTGCCTGCACCACTCACAGAATCTGCTGAGGGCCGTGA<br>GCAATATGCTGCAGAAGGCAAGGCAGACCCTGGAGTTTTATCCCTGCACCAGCGAG<br>GAGATCGACCACGAAGACATCACCAAGGACAAGACCAGCACAGTGGAGGCCTGCCT<br>GCCCCTGGAACTGACCAAGAACGAGTCCTGTCTGAACTCCCGGGAAACCAGCTTCA<br>TAACCAACGGCTCCTGTCTCGCCAGCAGGAAGACCAGCTTCATGATGGCCTGTGC<br>CTCAGCTCCATCTACGAGGACCTCAAGATGTACCAGGTTGAGTTCAAGACCATGAA<br>CGCCAAGCTCCTGATGGACCCCAAGAGGCAGATCTTCCTGGACCAGAATATGCTGG<br>CCGTGATCGATGAGTTAATGCAGGCGCTGAACTTCAACAGCGAGACGGTGCCCCAA<br>AAGTCCTCGCTGGAGGAGCCCGACTTCTACAAGACCAAGATCAAGCTGTGCATCCT<br>CCTGCACGCCTTCCGAATCCGGGCCGTAACCATCGACAGGGTGATGAGCTATCTCA<br>ACGCCTCCTGATAATAGGCTGGAGCCTCGGTGGCCATGCTTCTTGCCCCTTGGGCC<br>TCCCCCCAGCCCTCCTCCCCTTCCTGCACCCGTACCCCCCAAACACCATTGTCAC<br>ACTCCAGTGGTCTTTGAATAAAGTCTGAGTGGGCGGC |
| 131 | hIL12AB_031 (5'UTR ORF 3'UTR) | TCAAGCTTTTGGACCCTCGTACAGAAGCTAATACGACTCACTATAGGGAAATAAGA<br>GAGAAAAGAAGAGTAAGAAGAAATATAAGAGCCACCATGTGCCACCAGCAGCTCGT<br>GATCAGCTGGTTCTCGCTTGTGTTCCTGGCCTCCCCCCTCGTCGCCATCTGGGAGC<br>TGAAGAAAGACGTGTACGTGGTGGAGCTGGACTGGTATCCCGACGCCCCGGGGGAG<br>ATGGTGGTGCTGACCTGCGACACCCCGGAAGAGGACGGCATCACCTGGACGCTCGA<br>CCAGTCGTCCGAAGTGCTGGGGTCGGGCAAGACCCTCACCATCCAGGTGAAGGAGT<br>TCGGAGACGCCGGCCAGTACACCTGTCATAAGGGGGGGAGGTGCTGAGCCACAGC<br>CTCCTGCTCCTGCACAAAAAGGAGGACGGCATCTGGAGCACCGATATCCTCAAGGA<br>CCAGAAGGAGCCCAAGAACAAGCGTTCCTGAGGTGTGAGGCCAAGAACTACAGCG<br>GCCGGTTCACGTGTTGGTGGCTCACCACCATCTCCACCGACCTCACCTTCTCCGTG<br>AAGTCAAGCAGGGCAGCTCCGACCCCCAAGGCGTCACCTGCGGCGCCGCCACCCT<br>GAGCGCCGAGAGGGTCAGGGGGGATAACAAGGAATACGAGTACAGTGTGGAGTGCC<br>AAGAGGATAGCGCCTGTCCCGCCGCCGAAGAGCCTGCCCATCGAAGTGATGGTG<br>GACGCCGTGCACAAGCTGAAGTACGAGAACTACACCTCCAGCTTCTTCATCAGGGA<br>TATCATCAAGCCCGATCCCCCCAAGAACCTGCAGCTGAAGCCCCTGAAGAACAGCA |

SUMMARY OF SEQUENCES

| SEQ ID NO | Description | Sequence |
|---|---|---|
| | | GGCAGGTGGAGGTGAGCTGGGAGTATCCCGACACGTGGAGCACCCCGCACAGCTAC<br>TTCTCGCTGACCTTCTGCGTGCAGGTGCAAGGGAAGTCCAAGAGGGAGAAGAAGGA<br>TAGGGTGTTCACCGACAAAACGAGCGCCACCGTGATCTGCCGGAAGAATGCCAGCA<br>TCTCTGTGAGGGCCCAGGACAGGTACTATTCCAGCTCCTGGTCGGAGTGGGCCAGC<br>GTGCCCTGTAGCGGCGGGGGCGGGGCGGCAGCAGGAACCTCCCGGTTGCCACCCC<br>CGACCCCGGCATGTTTCCGTGCCTGCACCACTCGCAAAACCTGCTGCGCGGTCT<br>CCAACATGCTGCAAAAGCGCGCCAGACGCTGGAGTTCTACCCCTGCACCAGCGAG<br>GAGATCGATCATGAAGATATCACCAAAGACAAGACCTCGACCGTGGAGGCCTGCCT<br>GCCCCTGGAGCTCACCAAGAACGAAAGCTGCCTGAACAGCAGGGAGACAAGCTTCA<br>TCACCAACGGCAGCTGCCTGGCCTCCCGGAAGACCAGCTTCATGATGGCCCTGTGC<br>CTGTCCAGCATCTACGAGGATCTGAAGATGTACCAAGTGGAGTTTAAGACCATGAA<br>CGCCAAGCTGTTAATGGACCCCAAAAGGCAGATCTTCCTGGATCAGAACATGCTGG<br>CCGTCATCGACGAGCTGATGCAAGCCCTGAACTTCAACAGCGAGACGGTGCCCCAG<br>AAGAGCAGCCTCGAGGAGCCCGACTTCTATAAGACCAAGATAAAGCTGTGCATTCT<br>GCTGCACGCCTTCAGAATCAGGGCCGTGACCATCGATAGGGTGATGAGCTACCTGA<br>ACGCCAGCTGATAATAGGCTGGAGCCTCGGTGGCCATGCTTCTTGCCCCTTGGGCC<br>TCCCCCCAGCCCCTCCTCCCCTTCCTGCACCCGTACCCCCCAAACACCATTGTCAC<br>ACTCCAGTGGTCTTTGAATAAAGTCTGAGTGGGCGGC |
| 132 | hIL12AB_032<br>(5'UTR ORF<br>3'UTR) | TCAAGCTTTTGGACCCTCGTACAGAAGCTAATACGACTCACTATAGGGAAATAAGA<br>GAGAAAAGAAGAGTAAGAAGAAATATAAGAGCCACCATGTGTCACCAGCAGCTGGT<br>GATTTCCTGGTTCAGTCTGGTGTTTCTTGCCAGCCCCCTGGTGGCCATCTGGGAGC<br>TGAAGAAAGACGTATACGTCGTGGAGCTGGACTGGTATCCCGACGCTCCCGGCGAG<br>ATGGTGGTCCTCACCTGCGACACCCCAGAGGAGGACGGCATCACCTGGACCCTGGA<br>CCAGAGCTCCGAGGTCCTGGGCAGCGGTAAGACCCTCACCATCCAGGTGAAGGAGT<br>TTGGTGATGCCGGGCAGTATACCTGCCACAAGGGCGGCGAGGTGCTGTCCCACAGC<br>CTCCTGTTACTGCATAAGAAGGAGGATGGCATCTGGAGCACCGACATCCTCAAGGA<br>CCAGAAAGAGCCCAAGAACAAGACCTTTCTGCGGTGCGAGGCGAAAAATTACTCCG<br>GCCGGTTCACCTGCTGGTGGCTGACCACCATCAGCACGGACCTGACGTTCTCCGTG<br>AAGTCGAGCAGGGGGAGCTCCGATCCCCAGGGCGTGACCTGCGGCGCGGCCACCCT<br>GAGCGCCGAGCGCGTCCGCGGGGACAATAAGGAATACGAATATAGCGTGGAGTGCC<br>AGGAGGACAGCGCCTGCCCCGCGGCCGAGGAGAGCCTCCCGATCGAGGTGATGGTG<br>GATGCCGTCCACAAGCTCAAATACGAAAACTACACCAGCAGCTTCTTCATTAGGGA<br>CATCATCAAGCCCGACCCCCCCAAAAACCTGCAGCTGAAGCCCCTGAAGAACAGCC<br>GCCAGGTCGAGGTGTCATGGGAGTACCCAGACACCTGGAGCACCCCCCACTCCTAC<br>TTCAGCCTGACCTTCTGCGTCCAGGTGCAGGGAAAGTCCAAACGGGAGAAGAAGGA<br>TAGGGTCTTTACCGATAAGACGTCGGCCACCGTCATCTGCAGGAAGAACGCCAGCA<br>TAAGCGTGCGGGCGCAGGATCGGTACTACAGCTCGAGCTGGTCCGAATGGGCCTCC<br>GTGCCCTGTAGCGGAGGGGGTGGCGGGGGCAGCAGGAACCTGCCCGTGGCCACCCC<br>GGACCCGGGCATGTTTCCCTGCCTGCATCACAGTCAGAACCTGCTGAGGGCCGTGA<br>GCAACATGCTCCAGAAGGCCCGCCAGACCCTGGAGTTTTACCCCTGCACCAGCGAA<br>GAGATCGATCACGAAGACATCACCAAAGACAAGACCTCCACCGTGGAGGCCTGTCT<br>GCCCCTGGAGCTGACCAAGAACGAGAGCTGTCTGAACAGCAGGGAGACCTCCTTCA<br>TCACCAACGGCTCCTGCCTGGCATCCCGGAAGACCAGCTTCATGATGGCCCTGTGT<br>CTGAGCTCTATCTACGAGGACCTGAAGATGTACCAGGTCGAGTTCAAGACCATGAA<br>CGCCAAGCTGCTGATGGACCCCAAGCGACAGATATTCCTGGACCAGAACATGCTCG<br>CCGTGATCGATGAACTGATGCAAGCCCTGAACTTCAATAGCGAGACCGTGCCCCAG<br>AAAAGCAGCCTGGAGGAGCCCGACTTCTACAAGACCAAGATCAAACTGTGCATACT<br>GCTGCACGCGTTCAGGATCGGGCCGTCACCATCGACCGGGTGATGTCCTATCTGA<br>ATGCCAGCTGATAATAGGCTGGAGCCTCGGTGGCCATGCTTCTTGCCCCTTGGGCC<br>TCCCCCCAGCCCCTCCTCCCCTTCCTGCACCCGTACCCCCCAAACACCATTGTCAC<br>ACTCCAGTGGTCTTTGAATAAAGTCTGAGTGGGCGGC |
| 133 | hIL12AB_033<br>(5'UTR ORF<br>3'UTR) | TCAAGCTTTTGGACCCTCGTACAGAAGCTAATACGACTCACTATAGGGAAATAAGA<br>GAGAAAAGAAGAGTAAGAAGAAATATAAGAGCCACCATGTGCCACCAGCAGCTCGT<br>GATTAGCTGGTTTTCGCTGGTGTTCCTGGCCAGCCCTCTCGTGGCCATCTGGGAGC<br>TGAAAAAAGACGTGTACGTGGTGGAGCTGGACTGGTACCCGGACGCCCCGGCGAG<br>ATGGTGGTGCTGACGTGCGACACCCCGGAAGAGGACGGCATCACCTGGACCCTGGA<br>CCAGTCATCCGAGGTCCTGGGCAGCGGCAAGACGCTCACCATCCAGGTGAAGGAGT<br>TCGGCGACGCCGGCCAGTACACATGCCATAAGGGCGGGGAGGTGCTGAGCCACAGC<br>CTGCTCCTCCTGCACAAGAAGGAGGATGGCATCTGGTCTACAGACATCCTGAAGGA<br>CCAGAAAGAGCCCAAGAACAAGACCTTCCTCCGGTGCGAGGCCAAGAACTACTCCG<br>GGCGGTTTACTTGTTGGTGGCTGACCACCATCAGCACCGACCTCACCTTCAGCGTG<br>AAGAGCTCCCGAGGGAGCTCCGACCCCCAGGGGGTCACCTGCGGCGCCGCCACCCT<br>GAGCGCCGAGCGGGTGAGGGGCGACAACAAGGAGTATGAATACAGCGTGGAATGCC<br>AAGAGGACAGCGCCTGTCCCGCGGCCGAGGAAAGCCTGCCCATCGAGGTGATGGTG<br>GACGCCGTCCACAAACTCAAGTACGAGAACTACACCAGCAGTTTCTTCATTCGCGA<br>CATCATCAAGCCGGACCCCCCAAAAACCTGCAGCTCAAACCCCTGAAGAACAGCA<br>GGCAGGTGGAGGTCAGCTGGGAGTACCCGGACACCTGGAGCACCCCCCATAGCTAC<br>TTCAGCCTGACCTTCTGCGTGCAGGTGCAGGGCAAGAGCAAACGCGAGAAGAAGGA<br>CCGGGTGTTTACCGACAAGACCAGCGCCACGGTGATCTGCCGAAAGAATGCAAGCA<br>TCTCCGTGAGGGCGCAGGACCGCTACTACTCTAGCAGCTGGAGCGAGTGGGCCAGC<br>GTGCCCTGCAGCGGTGGCGGCGGAGGCGGCAGCCGTAACCTCCCCGTGGCCACCCC |

SUMMARY OF SEQUENCES

| SEQ ID NO | Description | Sequence |
|---|---|---|
| | | CGACCCCGGCATGTTCCCGTGTCTGCACCACTCCCAGAACCTGCTGAGGGCCGTCA<br>GCAATATGCTGCAGAAGGCCCGGCAGACGCTGGAGTTCTACCCCTGCACCTCCGAG<br>GAGATCGACCATGAGGACATTACCAAGGACAAGACGAGCACTGTGGAGGCCTGCCT<br>GCCCCTGGAGCTCACCAAAAACGAGAGCTGCCTGAATAGCAGGGAGACGTCCTTCA<br>TCACCAACGGCAGCTGTCTGGCCAGCAGGAAGACCAGCTTCATGATGGCCCTGTGC<br>CTCTCCTCCATATATGAGGATCTGAAGATGTACCAGGTGGAGTTCAAGACCATGAA<br>CGCCAAGCTGCTGATGGATCCCAAGAGGCAGATCTTCCTGGACCAGAATATGCTGG<br>CCGTGATTGACGAGCTGATGCAGGCCCTGAACTTTAATAGCGAGACCGTCCCCCAG<br>AAGAGCAGCCTGGAGGAGCCCGACTTCTATAAGACCAAGATCAAGCTGTGCATACT<br>GCTGCACGCGTTTAGGATAAGGGCCGTCACCATCGACAGGGTGATGAGCTACCTGA<br>ATGCCAGCTGATAATAGGCTGGAGCCTCGGTGGCCATGCTTCTTGCCCCTTGGGCC<br>TCCCCCCAGCCCCTCCTCCCCTTCCTGCACCCGTACCCCCCAAACACCATTGTCAC<br>ACTCCAGTGGTCTTTGAATAAAGTCTGAGTGGGCGGC |
| 134 | hIL12AB_034 (5'UTR ORF 3'UTR) | TCAAGCTTTTGGACCCTCGTACAGAAGCTAATACGACTCACTATAGGGAAATAAGA<br>GAGAAAAGAAGAGTAAGAAGAAATATAAGAGCCACCATGTGCCACCAACAGCTGGT<br>GATCTCCTGGTTCAGCCTGGTGTTCCTCGCCAGCCCCCTGGTGGCCATCTGGGAGC<br>TGAAGAAAGACGTGTACGTGGTGGAGCTGGACTGGTATCCCGACGCCCCCGGCGAG<br>ATGGTCGTGCTGACCTGCGACACCCCGGAGGAGGACGGCATCACCTGGACCCTGGA<br>TCAGTCCTCCGAGGTGCTGGGCAGCGGGAAGACCCTGACCATCCAGGTGAAAGAGT<br>TCGGAGATGCCGGCCAGTATACCTGTCACAAGGGGGGTGAGGTGCTGAGCCATAGC<br>CTCTTGCTTCTGCACAAGAAGGAGGACGGCATCTGGTCCACCGACATCCTCAAGGA<br>CCAAAAGGAGCCGAAGAATAAAACGTTCCTGAGGTGCGAAGCCAAGAACTATTCCG<br>GACGGTTCACCTGCTGGTGGCTGACCACCATCAGCACCGACCTCACCTTCTCCGTA<br>AAGTCAAGCAGGGGCAGCTCCGACCCCCAGGGCGTGACCTGCGGAGCCGCCACCCT<br>GAGCGCAGAGAGGGTGAGGGGCGACAACAAGGAGTACGAATACTCCGTCGAGTGCC<br>AGGAGGACAGCGCCTGCCCCGCCGCCGAGGAAAGTCTGCCCATCGAGGTGATGGTG<br>GACGCCGTGCACAAGCTCAAATACGAGAACTACACCAGCAGCTTCTTCATCCGGGA<br>TATCATCAAGCCCGACCCTCCAAAGAATCTGCAGCTGAAACCCCTTAAGAACAGCA<br>GGCAGGTGGAGGTCAGCTGGGAGTACCCCGACACCTGGAGCACGCCCCACTCCTAC<br>TTTAGCCTGACCTTTTGCGTGCAGGTGCAGGGGAAAAGCAAGCGGGAGAAGAAGGA<br>CAGGGTGTTCACCGATAAGACCTCCGCTACCGTGATCTGCAGGAAGAACGCCTCAA<br>TCAGCGTGAGGGCCCAGGATCGGTACTACTCCAGCTCCTGGAGCGAGTGGGCCAGC<br>GTGCCCTGCTCTGGCCGGTGGCGGCGGGGGCAGCCGGAACCTGCCGGTGGCCACTCC<br>CGACCCGGGCATGTTCCCGTGCCTCCACCATTCCCAGAACCTGCTGCGGGCCGTGT<br>CCAATATGCTCCAGAAGGCAAGGCAGACCCTGGAGTTCTACCCCTGCACCAGCGAG<br>GAGATCGATCACGAGGACATCACCAAAGACAAAACCAGCACGGTCGAGGCCTGCCT<br>GCCCCTGGAACTCACCAAGAACGAAAGCTGTCTCAACAGCCGCGAGACCAGCTTCA<br>TAACCAACGGTTCCTGTCTGGCCTCCCGCAAGACCAGCTTTATGATGGCCCTCTGT<br>CTGAGCTCCATCTATGAAGACCTGAAAATGTACCAGGTGGAGTTCAAAACCATGAA<br>CGCCAAGCTTCTGATGGACCCCAAGAGGCAGATCTTCCTGGATCAGAACATGCTGG<br>CCGTGATCGACGAGCTGATGCAGGCCCTGAACTTTAACTCCGAGACCGTGCCCCAG<br>AAAAGCAGCCTGGAAGAGCCCGATTTCTACAAAACGAAGATCAAGCTGTGCATCCT<br>GCTGCACGCCTTCCGGATCCGTGCGGTGACCATCGATAGGGTGATGAGCTACCTGA<br>ACGCCAGCTGATAATAGGCTGGAGCCTCGGTGGCCATGCTTCTTGCCCCTTGGGCC<br>TCCCCCCAGCCCCTCCTCCCCTTCCTGCACCCGTACCCCCCAAACACCATTGTCAC<br>ACTCCAGTGGTCTTTGAATAAAGTCTGAGTGGGCGGC |
| 135 | hIL12AB_035 (5'UTR ORF 3'UTR) | TCAAGCTTTTGGACCCTCGTACAGAAGCTAATACGACTCACTATAGGGAAATAAGA<br>GAGAAAAGAAGAGTAAGAAGAAATATAAGAGCCACCATGTGCCACCAACAGCTGGT<br>AATCAGCTGGTTCAGCCTGGTTTTCCTCGCGTCGCCCCTGGTGGCCATCTGGGAGT<br>TAAAGAAGGACGTGTACGTGGTGGAGCTGGATTGGTACCCCGACGCCCCGGGCGAG<br>ATGGTCGTGCTCACCTGCGATACCCCCGAGGAGGACGGGATCACCTGGACCCTGGA<br>CCAATCCAGCGAGGTGCTGGGCAGCGGCAAGACCCTGACCATACAGGTGAAGGAAT<br>TTGGGGACGCCGGGCAGTACACCTGCCACAAGGGCGGGAAGTGCTGTCCCACTCC<br>CTCCTGCTGCTGCATAAGAAGGAGGACGGCATCTGGAGCACCGACATCCTGAAGGA<br>CCAAAAGGAGCCCAAGAACAAGACCTTCCTGAGGTGCGAGGCCAAAAACTATTCCG<br>GCCGCTTTACCTGTTGGTGGCTGACCACCATCTCCACCGATCTGACCTTCAGCGTG<br>AAGTCGTCTAGGGGCTCCTCCGACCCCCAGGGCGTAACCTGCGGCGCCGCGACCCT<br>GAGCGCCGAGAGGGTGCGGGGCGATAACAAAGAGTACGAGTACTCGGTGGAGTGCC<br>AGGAGGACAGCGCCTGTCCGGCGGCCGAGGAGAGCCTGCCCATCGAGGTGATGGTG<br>GACGCCGTCCACAAGCTGAAGTACGAGAACTACACCAGTTCGTTCTTCATCAGGGA<br>CATCATCAAGCCGGACCCCCCAAGAACCTCCAGCTGAAGCCCCTGAAGAACAGCA<br>GGCAGGTGGAAGTGTCCTGGGAGTATCCCGACACCTGGAGCACCCCCCACAGCTAC<br>TTCAGCCTGACCTTTTGCGTGCAGGTGCAGGGCAAAAGCAAGAGGGAAAAGAAGGA<br>CCGGGTGTTCACCGATAAGACGAGCGCCACCGTTATCTGCAGGAAGAACGCCTCCA<br>TAAGCGTGAGGGCGCAGGACCGTTACTACAGCAGCAGCTGGAGTGAGTGGGCAAGC<br>GTGCCCTGTAGCGGCGGGGCGGGGCGGGTCCCGCAACCTCCCCGTCGCCACCCC<br>CGACCCAGGCATGTTCCCGTGCCTGCACCACAGCCAGAACCTGCTGCGGGCCGTTA<br>GCAACATGCTGCAGAAGGCCAGGCAGACCCTCGAGTTCTATCCCTGCACATCTGAG<br>GAGATCGACCACGAAGACATCACTAAGGATAAGACCTCCACCGTGGAGGCCTGTCT<br>GCCCCTCGAGCTGACCAAGAATGAATCCTGCCTGAACAGCCGAGAGACCAGCTTTA<br>TCACCAACGGCTCCTGCCTGGCCAGCAGGAAGACCTCCTTCATGATGGCCCTGTGC |

| SEQ ID NO | Description | Sequence |
|---|---|---|
| | | CTCTCCAGCATCTACGAGGATCTGAAGATGTACCAGGTAGAGTTCAAGACGATGAA CGCCAAGCTCCTGATGGACCCCAAGAGGCAGATATTCCTGGACCAGAACATGCTGG CGGTGATCGACGAGCTGATGCAGGCCCTGAATTTCAACAGCGAGACGGTGCCACAG AAGTCCAGCCTGGAGGAGCCAGACTTCTACAAGACCAAGATCAAACTGTGCATCCT CCTGCACGCGTTCAGGATCCGCGCCGTCACCATAGACAGGGTGATGAGTTATCTGA ACGCCAGCTGATAATAGGCTGGAGCCTCGGTGGCCATGCTTCTTGCCCCTTGGGCC TCCCCCCAGCCCTCCTCCCCTTCCTGCACCCGTACCCCCCAAACACCATTGTCAC ACTCCAGTGGTCTTTGAATAAAGTCTGAGTGGGCGGC |
| 136 | hIL12AB_036 (5'UTR ORF 3'UTR) | TCAAGCTTTTGGACCCTCGTACAGAAGCTAATACGACTCACTATAGGGAAATAAGA GAGAAAAGAAGAGTAAGAAGAAATATAAGAGCCACCATGTGCCATCAGCAGCTGGT AATCAGCTGGTTTAGCCTGGTGTTCCTGGCCAGCCCACTGGTGGCCATCTGGGAGC TGAAGAAGGACGTGTACGTGGTGGAACTGGACTGGTACCCCGACGCCCCTGGCGAG ATGGTGGTACTGACCTGTGACACCCCGGAGGAAGACGGTATCACCTGGACCCTGGA TCAGAGCTCCGAGGTGCTGGGCTCCGGCAAGACACTGACCATCCAAGTTAAGGAAT TTGGGGACGCCGGCCAGTACACCTGCCACAAGGGGGGCGAGGTGCTGTCCCACTCC CTGCTGCTTCTGCATAAGAAGGAGGATGGCATCTGGTCCACCGACATACTGAAGGA CCAGAAGGAGCCCAAGAATAAGACCTTCCTGAGATGCGAGGCCAAGAACTACTCGG GAAGGTTCACCTGCTGGTGGCTGACCACCATCAGCACCGACCTGACCTTCTCCGTG AAGAGCTCCCGGGGCAGCTCCGACCCCCAGGGCGTAACCTGTGGGGCCGCTACCCT GTCCGCCGAGAGGGTCCGGGGCGACAACAAGGAATACGAGTACAGCGTGGAGTGCC AGGAGGACTCCGCCTGCCCCGCCGCCGAGGAGTCGCTGCCCATAGAGGTGATGGTG GACGCCGTGCACAAGCTCAAGTACGAGAATTACACCAGCAGCTTCTTTATCAGGGA CATAATTAAGCCGGACCCCCCAAAGAATCTGCAGCTGAAGCCCCTGAAGAATAGCC GGCAGGTGGAAGTGTCCTGGGAGTACCCCGACACCTGGAGCACCCCCCACTCCTAT TTCTCACTGACATTCTGCGTGCAGGTGCAAGGGAAAAGCAAGAGGGAGAAGAAGGA TAGGGTGTTCACCGACAAGACAAGCGCCACCGTGATCTGCCGAAAAAATGCCAGCA TCAGCGTGAGGGCCCAGGATCGGTATTACAGCAGCTCCTGGAGCGAGTGGGCCAGC GTGCCCTGTTCCGGCGGGGAGGGGCGGCTCCCGGAACCTGCCGGTGGCCACCCC CGACCCTGGCATGTTCCCCTGCCTGCATCACAGCCAGAACCTGCTCCGGGCCGTGT CGAACATGCTGCAGAAGGCCCGGCAGACCCTCGAGTTTTACCCCTGCACCAGCGAA GAGATCGACCACGAAGACATAACCAAGGACAAGACCAGCACGGTGGAGGCCTGCCT GCCCCTGGAGCTTACCAAAAACGAGTCCTGCCTGAACAGCCGGGAAACCAGCTTCA TAACGAACGGGAGCTGCCTGGCCTCCAGGAAGACCAGCTTCATGATGGCGCTGTGT CTGTCCAGCATATACGAGGATCTGAAGATGTATCAGGTGGAATTCAAAACTATGAA TGCCAAGCTCCTGATGGACCCCAAGAGGCAGATCTTCCTGGACCAGAACATGCTAG CCGTGATCGACGAGCTGATGCAGGCCCTCAACTTCAACTCGGAGACGGTGCCCCAG AAGTCCAGCCTCGAGGAGCCCGACTTCTACAAGACCAAGATCAAGCTGTGCATACT GCTGCATGCCTTCAGGATAAGGGCGGTGACTATCGACAGGGTCATGTCCTACCTGA ACGCCAGCTGATAATAGGCTGGAGCCTCGGTGGCCATGCTTCTTGCCCCTTGGGCC TCCCCCCAGCCCTCCTCCCCTTCCTGCACCCGTACCCCCCAAACACCATTGTCAC ACTCCAGTGGTCTTTGAATAAAGTCTGAGTGGGCGGC |
| 137 | hIL12AB_037 (5'UTR ORF 3'UTR) | TCAAGCTTTTGGACCCTCGTACAGAAGCTAATACGACTCACTATAGGGAAATAAGA GAGAAAAGAAGAGTAAGAAGAAATATAAGAGCCACCATGTGCCACCAACACTGGT GATCAGCTGGTTCTCCCTGGTGTTCCTGGCCAGCCCCCTGGTGGCCATCTGGGAGC TCAAAAAAGACGTGTACGTGGTGGAGCTCGATTGGTACCCAGACGCGCCGGGGGAA ATGGTGGTGCTGACCTGCGACACCCCAGAGGAGGATGGCATCACGTGGACGCTGGA TCAGTCCAGCGAGGTGCTGGGGAGCGGCAAGACGCTCACCATCCAGGTGAAGGAAT TTGGCGACGCGGGCCAGTATACCTGTCACAAGGGCGGCGAGGTGCTGAGCCACTCC CTGCTGCTGCTGCACAAGAAGGAGGATGGGATCTGGTCAACCGATATCCTGAAAGA CCAGAAGGAGCCCAAGAACAAGACCTTCCTGCGCTGCGAGGCCAAGAACTATAGCG GCAGGTTCACCTGCTGGTGGCTGACCACCATCAGCACCGACCTGACCTTCAGCGTG AAATCCTCCAGGGGCAGCAGCGACCCCCAGGGCGTGACCTGCGGTGCCGCCACGCT CTCCGCCGAGCGAGTGAGGGGTGACAACAAGGAGTACGAGTACAGCGTGGAATGTC AGGAGGACAGCGCCTGTCCCGCCGCCGAGGAGTCGCTGCCCATCGAGGTGATGGTC GACGCGGTGCACAAGCTCAAATACGAGAATTACACCAGCAGCTTCTTCATCAGGGA CATCATCAAGCCCGACCCCCCAAGAACCTGCAGCTGAAGCCCTTGAAGAACAGCA GGCAGGTGGAGGTGAGCTGGGAGTACCCGGACACCTGGAGCACCCCCCACTCCTAC TTCAGCCTGACGTTCTGTGTGCAGGTGCAGGGGAAGTCCAAGAGGGAGAAGAAGGA CCGGGTGTTCACCGACAAGACCAGCGCCACCGTGATATGCCGCAAGAACGCGTCCA TCAGCGTTCGCGCCCAGGACCGCTACTACAGCAGCTCCTGGTCCGAATGGGCCAGC GTGCCCTGCAGCGGTGGAGGGGCGGGGGCTCCAGGAATCTGCCGGTGGCCACCCC CGACCCCGGGATGTTCCCCGTGTCTGCATCACTCCCAGAACCTGCTGCGGGCCGTGA GCAATATGCTGCAGAAGGCCAGGCAGACGCTCGAGTTCTACCCCTGCACCTCCGAA GAGATCGACCATGAGGACATCACCAAGGACAAGACCAGCACCGTGGAGGCCTGCCT CCCCCTGGAGCTGACCAAAAACGAGAGCTGCCTGAACTCCAGGGAGACCAGCTTTA TAACCAACGGCAGCTGCCTCGCCTCCAGGAAGACCTCGTTTATGATGGCCCTCTGC CTGTCCAGCATCTACGAGGACCTGAAGATGTACCAGGTGGAGTTCAAGACCATGAA CGCGAAGTTGCTCATGGACCCCAAGAGGCAGATCTTCCTGGACCAGAACATGCTCG CGGTGATCGACGAGCTGATGCAAGCCCTGAACTTCAACAGCGAGACCGTGCCCCAG AAGAGCAGCCTGGAAGAGCCCGACTTCTACAAGACCAAGATCAAGCTGTGCATCCT GCTGCACGCCTTCCGGATCCGGGCCGTGACCATCGACAGGGTGATGAGCTACCTCA |

| SEQ ID NO | Description | Sequence |
|---|---|---|
| | | ACGCCTCCTGATAATAGGCTGGAGCCTCGGTGGCCATGCTTCTTGCCCCTTGGGCC TCCCCCCAGCCCTCCTCCCCTTCCTGCACCCGTACCCCCCAAACACCATTGTCAC ACTCCAGTGGTCTTTGAATAAAGTCTGAGTGGGCGGC |
| 138 | hIL12AB_038 (5'UTR ORF 3'UTR) | TCAAGCTTTTGGACCCTCGTACAGAAGCTAATACGACTCACTATAGGGAAATAAGA GAGAAAAGAAGAGTAAGAAGAAATATAAGAGCCACCATGTGCCACCAGCAGCTCGT GATCAGCTGGTTCTCCCTCGTCTTCCTGGCCTCCCCGCTGGTGGCCATCTGGGAGC TGAAGAAGGACGTGTACGTGGTGGAGCTGGACTGGTATCCCGACGCCCCCGGCGAG ATGGTGGTGCTGACGTGCGACACACCAGAAGAGGACGGGATCACATGGACCCTGGA TCAGTCGTCCGAGGTGCTGGGGAGCGGCAAGACCCTCACCATCCAAGTGAAGGAGT TCGGGGACGCCGGCCAGTACACCTGCCACAAGGGCGGGGAGGTGCTCTCCCATAGC CTGCTCCTCCTGCACAAAAAGGAGGATGGCATCTGGAGCACCGACATCCTGAAGGA CCAGAAGGAGCCCAAGAACAAGACATTTCTCAGGTGTGAGGCCAAGAACTATTCGG GCAGGTTTACCTGTTGGTGGCTCACCACCATCTCTACCGACCTGACGTTCTCCGTC AAGTCAAGCAGGGGGAGCTCGGACCCCCAGGGGGTGACATGTGGGGCCGCCACCCT GAGCGCGGAGCGTGTCCGCGGCGACAACAAGGAGTACGAGTATTCCGTGGAGTGCC AGGAGGACAGCGCCTGCCCCGCCGCCGAGGAGTCCCTGCCCATAGAGGTGATGGTG GACGCCGTCCACAAGTTGAAGTACGAAAATTATACCTCCTCGTTCTTCATTAGGGA CATCATCAAGCCTGACCCCCCGAAGAACCTACAACTCAAGCCCCTCAAGAACTCCC GCCAGGTGGAGGTGTCCTGGGAGTACCCCGACACCTGGTCCACCCCGCACAGCTAC TTCAGCCTGACCTTCTGCGTGCAGGTCCAGGGGAAGAGCAAGCGTGAAAAGAAAGA CAGGGTGTTCACCGACAAGACGAGCGCCACCGTGATCTGCAGGAAAAACGCCTCCA TCTCCGTGCGCGCCCAGGACAGGTACTACAGTAGCTCCTGGAGCGAATGGGCCAGC GTGCCGTGCAGCGGCGGGGAGGAGGCGGCAGTCGCAACCTGCCCGTGGCCACCCC CGACCCCGGCATGTTCCCATGCCTGCACCACAGCCAGAACCTGCTGAGGGCAGTCA GCAATATGCTGCAGAAGGCCAGGCAGACCCTGGAGTTTTATCCCTGCACCAGCGAG GAGATCGACCACGAGGACATCACCAAGGACAAGACCTCCACCGTCGAGGCCTGCCT GCCACTGGAGCTGACCAAAAACGAGAGCTGCCTGAACTCCAGGGAGACCTCCTTCA TCACCAACGGGAGCTGCCTGGCCAGCCGGAAGACCAGCTTCATGATGGCGCTGTGC CTCAGCAGCATCTACGAGGATCTCAAGATGTACCAGGTGGAGTTCAAGACCATGAA CGCGAAGCTGCTGATGGACCCCAAGCGGCAGATCTTCCTGGACCAGAACATGCTGG CCGTGATTGACGAGCTCATGCAGGCCCTGAACTTCAATAGCGAGACCGTCCCCCAA AAGAGCAGCCTGGAGGAACCCGACTTCTACAAAACGAAGATCAAGCTCTGCATCCT GCTGCACGCCTTCCGGATCCGGGCCGTGACCATCGATCGTGTGATGAGCTACCTGA ACGCCTCGTGATAATAGGCTGGAGCCTCGGTGGCCATGCTTCTTGCCCCTTGGGCC TCCCCCCAGCCCTCCTCCCCTTCCTGCACCCGTACCCCCCAAACACCATTGTCAC ACTCCAGTGGTCTTTGAATAAAGTCTGAGTGGGCGGC |
| 139 | hIL12AB_039 (5'UTR ORF 3'UTR) | TCAAGCTTTTGGACCCTCGTACAGAAGCTAATACGACTCACTATAGGGAAATAAGA GAGAAAAGAAGAGTAAGAAGAAATATAAGAGCCACCATGTGCCACCAGCAGCTCGT CATCTCCTGGTTTAGCCTGGTGTTTCTGGCCTCCCCCCTGGTCGCCATCTGGGAGC TGAAGAAGACGTGTACGTGGTGGAGCTGGACTGGTACCCGGACGCTCCCGGGGAG ATGGTGGTGCTGACCTGCGACACCCCCGAGGAGGACGGCATCACCTGGACCCTGGA CCAGAGCTCCGAGGTGCTGGGGAGCGGCAAGACCCTGACCATTCAGGTGAAAGAGT TCGGCGACGCCGGCCAATATACCTGCCACAAGGGGGGGGAGGTCCTGTCGCATTCC CTGCTGCTGCTTCACAAAAAGGAGGATGGCATCTGGAGCACCGACATCCTGAAGGA CCAGAAAGAACCCAAGAACAAGACGTTCCTGCGCTGCGAGGCCAAGAACTACAGCG GCCGGTTCACCTGTTGGTGGCTGACCACCATCTCCACCGACCTGACTTTCTCGGTG AAGAGCAGCCGCGGGAGCAGCGACCCCCAGGGAGTGACCTGCGGCGCCGCCACCCT GAGCGCCGAAAGGGTGAGGGGCGACAATAAAGAGTACGAGTATTCCGTGGAGTGCC AGGAGGACAGCGCCTGTCCCGCCGCCGAGGAGTCCCTGCCTATCGAGGTGATGGTC GACGCCGGTGCACAAGCTCAAGTACGAAAACTACACCAGCAGCTTTTTCATCAGGGA TATCATCAAACCAGACCCCCCCAAGAACCTGCAGCTGAAGCCCCTGAAAAACAGCA GGCAGGTGGAAGTGAGCTGGGAATACCCCGATACCTGGTCCACCCCCCACAGCTAC TTCAGCCTGACCTTCTGCGTGCAGGTGCAGGGGAAGTCCAAGCGGGAGAAGAAGA TCGGGTGTTCACGGACAAGACCAGCGCCACCGTGATTTGCAGGAAAAACGCCAGCA TCTCCGTGAGGGCTCAGGACAGGTACTACAGCTCCAGCTGGAGCGAGTGGGCCTCC GTGCCTTGCAGCGGGGAGGAGGCGGCGGCAGCAGGAATCTGCCCGTCGCAACCCC CGACCCCGGCATGTTCCCCTGCCTGCACCACAGCCAGAATCTGCTGCGAGCCGTGA GCAACATGCTCCAGAAGGCCCGGCAGACGCTGGAGTTCTACCCCTGCACCTCCGAG GAGATCGACCACGAGGACATCACCAAGGATAAGACGAGCACCGTCGAGGCCTGTCT CCCCCTGGAGCTCACCAAGAACGAGTCCTGCCTGAATAGCAGGGAGACGTCCTTCA TAACCAACGGCAGCTGTCTGGCGTCCAGGAAGACCAGCTTCATGATGGCCCTCTGC CTGAGCTCCATCTACGAGGACCTCAAGATGTACCAGGTCGAGTTCAAGACCATGAA CGCAAAACTGCTCATGGATCCAAAGAGGCAGATCTTTCTGGACCAGAACATGCTGG CCGTGATCGATGAACTCATGCAGGCCCTGAATTTCAATTCCGAGACCGTGCCCCAG AAGAGCTCCCTGGAGGAACCCGACTTCTACAAAACAAAGATCAAGCTGTGTATCCT CCTGCACGCCTTCCGGATCAGGGCCGTCACCATTGACCGGGTGATGTCCTACCTGA ACGCCAGCTGATAATAGGCTGGAGCCTCGGTGGCCATGCTTCTTGCCCCTTGGGCC TCCCCCCAGCCCTCCTCCCCTTCCTGCACCCGTACCCCCCAAACACCATTGTCAC ACTCCAGTGGTCTTTGAATAAAGTCTGAGTGGGCGGC |

| SUMMARY OF SEQUENCES | | |
|---|---|---|
| SEQ ID NO | Description | Sequence |
| 140 | hIL12AB_040 (5'UTR ORF 3'UTR) | TCAAGCTTTTGGACCCTCGTACAGAAGCTAATACGACTCACTATAGGGAAATAAGA GAGAAAAGAAGAGTAAGAAGAAATATAAGAGCCACCATGTGCCATCAGCAGCTGGT GATCAGCTGGTTCAGCCTCGTGTTCCTCGCCAGCCCCTCGTGGCCATCTGGGAGC TGAAAAAGGACGTGTACGTGGTGGAGCTGGACTGGTATCCCGACGCCCCGGGCGAG ATGGTGGTGCTGACCTGCGACACCCCGAGGAGGACGGCATTACCTGGACACTGGA CCAGAGCAGCGAGGTCCTGGGCAGCGGGAAGACCCTGACAATTCAGGTGAAGGAGT TCGGCGACGCCGGACAGTACACGTGCCACAAGGGGGGGAGGTGCTGTCCCACAGC CTCCTCCTGCTGCACAAGAAGGAGGATGGCATCTGGAGCACCGACATCCTGAAGGA TCAGAAGGAGCCCAAGAACAAGACCTTTCTGAGATGCGAGGCCAAGAATTACAGCG GCCGTTTCACCTGCTGGTGGCTCACCACCATCAGCACCGACCTGACCTTCAGCGTG AAATCCTCCAGGGGCTCCTCCGACCCGCAGGGAGTGACCTGCGGCGCCGCCACACT GAGCGCCGAGCGGGTCAGAGGGGACAACAAGGAGTACGAGTACAGCGTTGAGTGCC AGGAGGACAGCGCCTGTCCCGCGGCCGAGGAATCCCTGCCCATCGAGGTGATGGTG GACGCAGTGCACAAGCTGAAGTACGAGAACTATACCTCGAGCTTCTTCATCCGGGA TATCATTAAGCCCGATCCCCCGAAGAACCTGCAGCTCAAACCCCTGAAGAACAGCA GGCAGGTGGAGGTCTCCTGGGAGTACCCCGACACATGGTCCACCCCCCATTCCTAT TTCTCCCTGACCTTTTGCGTGCAGGTGCAGGGCAAGAGCAAGAGGGAGAAAAAGGA CAGGGTGTTCACCGACAAGACCTCCGCCACCGTGATCTGCCGTAAGAACGCTAGCA TCAGCGTCAGGGCCCAGGACAGGTACTATAGCAGCTCCTGGTCCGAGTGGGCCAGC GTCCCGTGCAGCGGCGGGGCGGTGGAGGCTCCCGGAACCTCCCCGTGGCCACCCC GGACCCCGGGATGTTTCCCTGCCTGCATCACAGCCAGAACCTGCTGAGGGCCGTGT CCAACATGCTGCAGAAGGCCAGGCAGACACTCGAGTTTTACCCCTGCACCAGCGAG GAGATCGACCACGAAGACATCACCAAGGACAAGACCTCCACCGTGGAGGCATGCCT GCCCCTGGAGCTGACCAAAAACGAAAGCTGTCTGAACTCCAGGGAGACCTCCTTTA TCACGAACGGCTCATGCCTGGCCTCCAGAAAGACCAGCTTCATGATGGCCCTGTGC CTGAGCTCCATCTACGAGGACTTGAAAATGTACCAGGTCGAGTTCAAGACCATGAA CGCCAAGCTGCTCATGGACCCCAAAAGGCAGATCTTTCTGGACCAGAATATGCTGG CCGTGATCGACGAGCTCATGCAAGCCCTGAATTTCAACAGCGAGACCGTGCCCCAG AAGTCCTCCCTGGAGGAGCCCGACTTCTACAAGACCAAGATCAAGCTGTGCATACT CCTGCACGCGTTTAGGATCAGGGCGGTGACCATCGATAGGGTGATGAGCTACCTGA ATGCCTCCTGATAATAGGCTGGAGCCTCGGTGGCCATGCTTCTTGCCCCCTTGGGCC TCCCCCCAGCCCCTCCTCCCCTTCCTGCACCCGTACCCCCCAAACACCATTGTCAC ACTCCAGTGGTCTTTGAATAAAGTCTGAGTGGGCGGC |
| 141 | hIL12AB_001 (mRNA with T100 tail) | G*GGGAAAUAAGAGAGAAAAGAAGAGUAAGAAGAAAUAUAAGAGCCACCAUGUGUC ACCAGCAGCUGGUCAUUAGCUGGUUUUAGCCUUGUGUUCCUGGCCUCCCCCUUGUC GCUAUUUGGGAGCUCAAGAAGGACGUGUACGUGGUGGAGUUGGAUUGGUACCCAGA CGCGCCCGGAGAGAUGGUAGUUCUGACCUGUGAUACCCCAGAGGAGGACGGCAUCA CCUGGACGCUGGACCAAAGCAGCGAGGUUUUGGGCUCAGGGAAAACGCUGACCAUC CAGGUGAAGGAAUUCGGCGACGCCGGGCAGUACACCUGCCAUAAGGGAGGAGAGGU GCUGAGCCAUUCCCUUCUUCUGCUGCACAAGAAGGAGGACGGCAUCUGGUCUACCG ACAUCCUGAAAGACCAGAAGGAGCCCAAGAACAAAACCUUCCUGAGGUGCGAGGCC AAGAACUACUCCGGCAGGUUCACUUGUUGGUGGCUGACCACCAUCAGUACAGACCU GACUUUUAGUGUAAAAAGCUCCAGAGGCUCGUCCGAUCCCCAAGGGGUGACCUGCG GCGCAGCCACUCUGAGCGCUGAGCGCGUGCGCGGUGACAAUAAAGAGUACGAGUAC AGCGUUGAGUGUCAAGAAGAUAGCGCUUGCCCUGCCGCCGAGGAGAGCCUGCCUAU CGAGGUGAUGGUUGACGCAGUGCACAAGCUUAAGUACGAGAAUUACACCAGCUCAU UCUUCAUUAGAGAUAUAAUCAAGCCUGACCCACCCAAGAACCUGCAGCUGAAGCCA CUGAAAAACUCACGGCAGGUCGAAGUGAGCUGGGAGUACCCCGACACCUGGAGCAC UCCUCAUUCCUAUUUCUCUCUUACAUUCUGCGUCCAGGUGCAGGGCAAGAGCAAGC GGGAAAAGAAGGAUCGAGUCUUCACCGACAAAACAAGCGCGACCGUGAUUUGCAGG AAGAACGCCAGCAUCUCCGUCAGAGCCCAGGAUAGAUACUAUAGUAGCAGCUGGAG CGAGUGGGCAAGCGUGCCCUGUUCCGGCGGCGGGGGCGGGGGCAGCCGAAACUUGC CUGUCGCUACCCCGGACCCUGGAAUGUUUCCGUGUCUGCCACCACAGCCAGAACCUG CUGAGAGCCGUGUCGAAUAUGCUCCAGAAGGCCCGGCAGACCCUUGAGUUCUACCC CUGUACCAGCGAAGAGAUCGAUCAUGAAGAUAUCACGAAAGAUAAAACAUCCACCG UCGAGGCUUGUCUCCCGCUGGAGCUGACCAAGAACGAGAGCUGUCUGAAUAGCCGG GAGACGUCUUUCAUCACGAAUGGUAGCUGUCUGGCCAGCAGGAAAACUUCCUUCAU GAUGGCUCUCUGCCUGAGCUCUAUCUAUGAAGAUCUGAAGAUGUAUCAGGUGGAGU UUAAAACAAUGAACGCCAAACUCCUGAUGGACCCAAAAAGGCAAAUCUUUCUGGAC CAGAAUAUGCUGGCCGUGAUAGACGAGCUGAUGCAGGCACUGAACUUCAACAGCGA GACGGUGCCACAGAAAUCCAGCCUGGAGGAGCCCUGACUUUUACAAAACUAAGAUCA AGCUGUGUAUCCUGCUGCACGCCUUUAGAAUCCGUGCCGUGACUAUCGACAGGGUG AUGUCAUACCUCAACGCUUCAUGAUAAUAGGCUGGAGCCUCGGUGGCCAUGCUUCU UGCCCCUUGGGCCUCCCCCCAGCCCCUCCUCCCCUUCCUGCACCCGUACCCCCCAA ACACCAUUGUCACACUCCAGUGGUCUUUGAAUAAAGUCUGAGUGGGCGGCAAAAAA AAAAAAAAAAAAAAAAAAAAAAAAAAAAAAAAAAAAAAAAAAAAAAAAAAAAAAA AAAAAAAAAAAAAAAAAAAAAAAAAAAAAAAAAAAAAAAUCUAG G* = a 5' terminal guanosine cap |
| 142 | hIL12AB_002 (mRNA with T100 tail) | G*GGGAAAUAAGAGAGAAAAGAAGAGUAAGAAGAAAUAUAAGAGCCACCAUGUGCC ACCAGCAGCUGGUGAUCAGCUGGUUCAGCCUGGUGUUCUGGCCAGCCCCCUGGUG GCCAUCUGGGAGCUGAAGAAGGACGUGUACGUGGUGGAGUUGGAUUGGUACCCCGA |

| SEQ ID NO | Description | Sequence |
|---|---|---|
| | | CGCCCCCGGCGAGAUGGUGGUGCUGACCUGCGACACCCCCGAGGAGGACGGCAUCA CCUGGACCCUGGACCAGAGCAGCGAGGUGCUGGGCAGCGGCAAGACCCUGACCAUC CAGGUGAAGGAGUUCGGCGACGCCGGCCAGUACACCUGCCACAAGGGCGGCGAGGU GCUGAGCCACAGCCUGCUGCUGCUGCACAAGAAGGAGGACGGCAUCUGGAGCACCG ACAUCCUGAAGGACCAGAAGGAGCCCAAGAACAAGACCUUCCUGAGAUGCGAGGCC AAGAACUACAGCGGCAGAUUCACCUGCUGGUGGCUGACCACCAUCAGCACCGACCU GACCUUCAGCGUGAAGAGCAGCAGAGGCAGCGACCCCCAGGGCGUGACCUGCGG CGCGCCGCCACCCUGAGCGCCGAGAGAGUGAGAGGCGACAACAAGGAGUACGAGUAC AGCGUGGAGUGCCAGGAAGAUAGCGCCUGCCCCGCCGCCGAGGAGAGCCUGCCCAU CGAGGUGAUGGUGGACGCCGUGCACAAGCUGAAGUACGAGAACUACACCAGCAGCU UCUUCAUCAGAGAUAUCAUCAAGCCCGACCCCCCCAAGAACCUGCAGCUGAAGCCC CUGAAGAACAGCCGGCAGGUGGAGGUGAGCUGGGAGUACCCCGACACCUGGAGCAC CCCCCACAGCUACUUCAGCCUGACCUUCUGCGUGCAGGUGCAGGGCAAGAGCAAGA GAGAGAAGAAAGAUAGAGUGUUCACCGACAAGACCAGCGCCACCGUGAUCUGCAGA AAGAACGCCAGCAUCAGCGUGAGAGCCCAAGAUAGAUACAGCAGCAGCUGGAG CGAGUGGGCCAGCGUGCCCUGCAGCGGCGGCGGCGGCGGCGGCAGCAGAAACCUGC CGGUGGCCACCCCCGACCCCGGCAUGUUCCCCUGCCUGCACCACAGCCAGAACCUG CUGAGAGCCGUGAGCAACAUGCUGCAGAAGGCCCGGCAGACCCUGGAGUUCUACCC CUGCACCAGCGAGGAGAUCGACCACGAAGAUAUCACCAAAGAUAAGACCAGCACCG UGGAGGCCUGCCUGCCCCUGGAGCUGACCAAGAACGAGAGCUGCCUGAACAGCAGA GAGACCAGCUUCAUCACCAACGGCAGCUGCCUGGCCAGCAGAAAGACCAGCUUCAU GAUGGCCCUGUGCCUGAGCAGCAUCUACGAGGACCUGAAGAUGUACCAGGUGGAGU UCAAGACCAUGAACGCCAAGCUGCUGAUGGACCCCAAGCGGCAGAUCUUCCUGGAC CAGAACAUGCUGGCCGUGAUCGACGAGCUGAUGCAGGCCCUGAACUUCAACAGCGA GACCGUGCCCCAGAAGAGCAGCCUGGAGGAGCCCGACUUCUACAAGACCAAGAUCA AGCUGUGCAUCCUGCUGCACGCCUUCAGAAUCAGACCGUGACCAUCGACAGAGUG AUGAGCUACCUGAACGCCAGCUGAUAAUAGGCUGGAGCCUCGGUGGCCAUGCUUCU UGCCCCUUGGGCCUCCCCCCAGCCCCUCCUCCCCUUCCUGCACCCGUACCCCCCAA ACACCAUUGUCACACUCCAGUGGUCUUUGAAUAAAGUCUGAGUGGGCGGCAAAAA AAAAAAAAAAAAAAAAAAAAAAAAAAAAAAAAAAAAAAAAAAAAAAAAAAA AAAAAAAAAAAAAAAAAAAAAAAAAAAAAAAAAAAAAAAUCUAG G* = a 5' terminal guanosine cap |
| 143 | hIL12AB_003 (mRNA with T100 tail) | G*GGGAAAUAAGAGAAAAGAAGAGUAAGAAGAAAUAUAAGAGCCACCAUGUGUC ACCAGCAGUUGGUCAUCUCUUGGUUUUCCCUGGUUUUUCUGGCAUCUCCCCUCGUG GCCAUCUGGGAACUGAAGAAAGACGUUUACGUUGUAGAAUUGGAUUGGUAUCCGGA CGCUCCUGGAGAAAUGGUGGUCCUCACCUGUGACACCCCUGAAGAAGACGGAAUCA CCUGGACCUUGGACCAGAGCAGUGAGGUCUUUAGGCUCUGGCAAAACCCUGACCAUC CAAGUCAAAGAGUUUGGAGAUGCUGGCCAGUACACCUGUCACAAAGGAGGCGAGGU UCUAAGCCAUUCGCUCCUGCUGCUUCACAAAAAGGAAGAUGGAAUUUGGUCCACUG AUAUUUUAAAGGACCAGAAAGAACCCAAAAAUAAGACCUUUCUAAGAUGCGAGGCC AAGAAUUAUUCUGGACGUUUCACCUGCUGGUGGCUGACGACAAUCAGUACUGAUUU GACAUUCAGUGUCAAAAGCAGCAGAGGCUCUUCUGACCCCCAAGGGGUGACGUGCG GAGCUGCUACACUCUCUGCAGAGAGAGUCAGAGGUGACAACAAGGAGUAUGAGUAC UCAGUGGAGUGCCAGGAAGAUAGUGCCUGCCCAGCUGCUGAGGAGAGCUGCCCAU UGAGGUCAUGGUGGAUGCCGUUCACAAGCUCAAGUAUGAAAACUACACCAGCAGCU UCUUCAUCAGAGAUAUCAUCAAACCUGACCCACCCAAGAACUUGCAGCUGAAGCCA UUAAAGAAUUCUCGGCAGGUGGAGGUCAGCUGGGAGUACCCCGACACCUGGAGUAC UCCACAUUCCUACUUCUCCCUGACAUUCUGCGUUCAGGUCCAGGGCAAGAGCAAGA GAGAAAAGAAAGAUAGAGUCUUCACAGAUAAGACCUCAGCCACGGUCAUCUGCCGC AAAAAUGCCAGCAUUAGCGUGCGGGCCCAGGACCGCUACUAUAGCUCAUCUUGGAG CGAAUGGGCAUCUGUGCCCUGCAGUGGCGGAGGGGCGGAGGGAGCAGAAACCUCC CCGUGGCCACUCCAGACCCAGGAAUGUUCCCAUGCCUUCACCACUCCCAAAACCUG CUGAGGGCCGUCAGCAACAUGCUCCAGAAGGCCCGGCAAACUUUAGAAUUUUACCC UUGCACUUCUGAAGAGAUUGAUCAUGAAGAUAUCACAAAAGAUAAAACCAGCACAG UGGAGGCCUGUUUACCAUUGGAAUUAACCAAGAAUGAGAGUUGCCUAAAUUCCAGA GAGACCUCUUUCAUAACUAAUGGGAGUUGCCUGGCCUCCAGAAAGACCUCUUUUAU GAUGGCCCUGUGCCUUAGUAGUAUUUAUGAAGAUUUGAAGAUGUACCAGGUGGAGU UCAAGACCAUGAAUGCAAAGCUUCUGAUGGAUCCUAAGAGGCAGAUCUUUUUAGAU CAAAACAUGCUGGCAGUUAUUGAUGAGCUGAUGCAGGCCCUGAAUUUCAACAGUGA GACGGUGCCACAAAAAUCCUCCCUUGAAGAACCAGAUUUCUACAAGACCAAGAUCA AGCUCUGCAUACUUCUUCAUGCUUUCAGAAUUCGGGCAGUACUAUUGAUAGAGUG AUGAGCUAUCUGAAUGCUUCCUGAUAAUAGGCUGGAGCCUCGGUGGCCAUGCUUCU UGCCCCUUGGGCCUCCCCCCAGCCCCUCCUCCCCUUCCUGCACCCGUACCCCCCAA ACACCAUUGUCACACUCCAGUGGUCUUUGAAUAAAGUCUGAGUGGGCGGCAAAAA AAAAAAAAAAAAAAAAAAAAAAAAAAAAAAAAAAAAAAAAAAAAAAAAAAA AAAAAAAAAAAAAAAAAAAAAAAAAAAAAAAAAAAAAAAUCUAG G* = a 5' terminal guanosine cap |
| 144 | hIL12AB_004 (mRNA with T100 tail) | G*GGGAAAUAAGAGAGAAAAGAAGAGUAAGAAGAAAUAUAAGAGCCACCAUGGGCU GCCACCAGCAGCUGGUCAUCAGCUGGUUCUCCCUGGUCUUCCUGGCCAGCCCCCUG GUGGCCAUCUGGGAGCUGAAGAAAGACGUCUACGUAGUAGAGUGGAUUGGUACCC AGACGCACCUGGAGAAAUGGUGGUUCUCACCUGUGACACGCCAGAAGAAGACGGUA |

-continued

SUMMARY OF SEQUENCES

| SEQ ID NO | Description | Sequence |
|---|---|---|
| | | UCACCUGGACGCUGGACCAGAGCUCAGAAGUUCUUGGCAGUGGAAAAACGCUGACC AUACAAGUAAAAGAAUUUGGGGAUGCUGGCCAGUACACCUGCCACAAAGGAGGAGA AGUUCUCAGCCACAGCCUGCUGCUGCUGCACAAGAAAGAAGAUGGCAUCUGGAGCA CAGAUAUUUUAAAAGACCAGAAGGAGCCCAAGAACAAAACCUUCCUUCGAUGUGAG GCCAAGAACUACAGUGGCCGCUUCACCUGCUGGUGGCUCACCACCAUCAGCACAGA CCUCACCUUCUCGGUGAAGAGCAGCCGUGGCAGCUCAGACCCCCAAGGAGUCACCU GUGGGGCGGCCACGCUGUCGGCAGAAAGAGUUCGAGGUGACAACAAGGAAUAUGAA UACUCGGUGGAAUGUCAAGAAGAUUCGGCCUGCCCGGCGGCAGAAGAAAGUCUUCC CAUAGAAGUCAUGGUGGAUGCUGUUCACAAAUUAAAAAUAUGAAAACUACACCAGCA GCUUCUUCAUCAGAGAUAUCAUCAAGCCAGACCCGCCCAAGAACCUGCAGCUGAAG CCCCUGAAGAACAGCCGGCAGGUGGAAGUUUCUGGGAGUACCCAGAUACGUGGAG CACGCCGCACAGCUACUUCAGCCUCACCUUCUGUGUACAAGUACAAGGCAAGAGCA AGAGAGAGAAGAAAGAUCGUGUCUUCACAGAUAAAACCUCGGCGACGGUCAUCUGC AGGAAGAAUGCCUCCAUCUCGGUUCGAGCCCAGGACCGCUACUACAGCAGCAGCUG GAGUGAGUGGGCCUCGGUGCCCUGCAGUGGUGGCGGCGGCGGCGGCAGCAGAAACC UUCCUGUGGCCACGCCGGACCCUGGCAUGUUCCCGUGCCUGCACCACAGCCAAAAU UUACUUCGAGCUGUUUCUAACAUGCUGCAGAAAGCACGGCAAACUUUAGAAUUCUA CCCCUGCACCUCAGAAGAAAUAGACCAUGAAGAUAUCACCAAAGAUAAAACCAGCA CUGUAGAGGCCUGCCUGCCCCUGGAGCUCACCAAGAAUGAAUCCUGCCUCAACAGC AGAGAGACCAGCUUCAUCACCAAUGGCAGCUGCCUGGCCAGCAGGAAAACCAGCUU CAUGAUGGCGCUCUGCCUGAGCAGCAUCUAUGAAGAUUUGAAGAUGUACCAAGUAG AAUUUAAAACCAUGAAUGCCAAGCUGCUCAUGGACCCCAAGCGGCAGAUAUUUUUG GAUCAAAACAUGCUGGCUGUCAUUGAUGAGCUCAUGCAAGCAUUAAACUUCAACUC AGAGACGGUGCCCCAGAAGAGCAGCCUGGAGGAGCCAGAUUUCUACAAAACCAAGA UCAAGCUCUGCAUCUUAUUACAUGCCUUCCGCAUCCGGGCGGUCACCAUUGACCGU GUCAUGUCCUACUUAAAUGCCAGCUGAUAAUAGGCUGGAGCCUCGGUGGCCAUGCU UCUUGCCCCUUGGGCCUCCCCCCAGCCCCUCCUCCCCUUCCUGCACCCGUACCCCC CAAACACCAUUGUCACACUCCAGUGGUCUUUGAAUAAAGUCUGAGUGGGCGGCAAA AAAAAAAAAAAAAAAAAAAAAAAAAAAAAAAAAAAAAAAAAAAAAAAAAAAAAAAAA AAAAAAAAAAAAAAAAAAAAAAAAAAAAAAAAAAAAAAAAAUCUAG G* = a 5' terminal guanosine cap |
| 145 | hIL12AB_005 (mRNA with T100 tail) | G*GGGAAAUAAGAGAGAAAAGAAGAGUAAGAAGAAAUAUAAGAGCCACCAUGUGCC ACCAGCAGCUGGUCAUCAGCUGGUUCUCCCUGGUCUUCCUGGCCAGCCCCCUGGUG GCCAUCUGGGAGCUGAAGAAAGACGUCUACGUAGUAGAGUUGGAUUGGUACCCAGA CGCACCUGGAGAAAUGGUGGUUCUCACCUGUGACACGCCAGAAGAAGACGGUAUCA CCUGGACGCUGGACCAGAGCUCAGAAGUUCUUGGCAGUGGAAAAACGCUGACCAUA CAAGUAAAAGAAUUUGGGGAUGCUGGCCAGUACACCUGCCACAAAGGAGGAGAAGU UCUCAGCCACAGCCUGCUGCUGCUGCACAAGAAAGAAGAUGGCAUCUGGAGCACAG AUAUUUUAAAAGACCAGAAGGAGCCCAAGAACAAAACCUUCCUUCGAUGUGAGGCC AAGAACUACAGUGGCCGCUUCACCUGCUGGUGGCUCACCACCAUCAGCACAGACCU CACCUUCUCGGUGAAGAGCAGCCGUGGCAGCUCAGACCCCCAAGGAGUCACCUGUG GGGCGGCCACGCUGUCGGCAGAAAGAGUUCGAGGUGACAACAAGGAAUAUGAAUAC UCGGUGGAAUGUCAAGAAGAUUCGGCCUGCCCGGCGGCAGAAGAAAGUCUUCCCAU AGAAGUCAUGGUGGAUGCUGUUCACAAAUUAAAAAUAUGAAAACUACACCAGCAGCU UCUUCAUCAGAGAUAUCAUCAAGCCAGACCCGCCCAAGAACCUGCAGCUGAAGCCC CUGAAGAACAGCCGGCAGGUGGAAGUUUCUGGGAGUACCCAGAUACGUGGAGCAC GCCGCACAGCUACUUCAGCCUCACCUUCUGUGUACAAGUACAAGGCAAGAGCAAGA GAGAGAAGAAAGAUCGUGUCUUCACAGAUAAAACCUCGGCGACGGUCAUCUGCAGG AAGAAUGCCUCCAUCUCGGUUCGAGCCCAGGACCGCUACUACAGCAGCAGCUGGAG UGAGUGGGCCUCGGUGCCCUGCAGUGGUGGCGGCGGCGGCGGCAGCAGAAACCUUC CUGUGGCCACGCCGGACCCUGGCAUGUUCCCGUGCCUGCACCACAGCCAAAAUUUA CUUCGAGCUGUUUCUAACAUGCUGCAGAAAGCACGGCAAACUUUAGAAUUCUACCC CUGCACCUCAGAAGAAAUAGACCAUGAAGAUAUCACCAAAGAUAAAACCAGCACUG UAGAGGCCUGCCUGCCCCUGGAGCUCACCAAGAAUGAAUCCUGCCUCAACAGCAGA GAGACCAGCUUCAUCACCAAUGGCAGCUGCCUGGCCAGCAGGAAAACCAGCUUCAU GAUGGCGCUCUGCCUGAGCAGCAUCUAUGAAGAUUUGAAGAUGUACCAAGUAGAAU UUAAAACCAUGAAUGCCAAGCUGCUCAUGGACCCCAAGCGGCAGAUAUUUUUGGAU CAAAACAUGCUGGCUGUCAUUGAUGAGCUCAUGCAAGCAUUAAACUUCAACUCAGA GACGGUGCCCCAGAAGAGCAGCCUGGAGGAGCCAGAUUUCUACAAAACCAAGAUCA AGCUCUGCAUCUUAUUACAUGCCUUCCGCAUCCGGGCGGUCACCAUUGACCGUGUC AUGUCCUACUUAAAUGCCAGCUGAUAAUAGGCUGGAGCCUCGGUGGCCAUGCUUCU UGCCCCUUGGGCCUCCCCCCAGCCCCUCCUCCCCUUCCUGCACCCGUACCCCCAA ACACCAUUGUCACACUCCAGUGGUCUUUGAAUAAAGUCUGAGUGGGCGGCAAAAAA AAAAAAAAAAAAAAAAAAAAAAAAAAAAAAAAAAAAAAAAAAAAAAAAAAAAAAAAA AAAAAAAAAAAAAAAAAAAAAAAAAAAAAAAAAAAAAAAAAUCUAG G* = a 5' terminal guanosine cap |
| 146 | hIL12AB_006 (mRNA with T100 tail) | G*GGGAAAUAAGAGAGAAAAGAAGAGUAAGAAGAAAUAUAAGAGCCACCAUGUGCC ACCAGCAGCUGGUGAUCAGCUGGUUCAGCUGGUGUUCCUGGCCAGCCCCCUGGUG GCCAUCUGGGAGCUGAAGAAGGACGUGUACGUGGUGGAGUUGGAUUGGUACCCCGA CGCCCCGGCGAGAUGGUGGUGCUGACCUGUGACACCCCGAGGAGGACGGCAUCA CCUGGACCCUGGACCAGAGCAGCGAGGUGCUGGGCAGCGGCAAGACCCUGACCAUC |

SUMMARY OF SEQUENCES

| SEQ ID NO | Description | Sequence |
|---|---|---|
| | | CAGGUGAAGGAGUUCGGGGACGCCGGCCAGUACACCUGCCACAAGGGCGGCGAGGU GCUGAGCCACAGCCUGCUGCUGCUGCACAAGAAGGAGGACGGCAUCUGGAGCACAG AUAUCCUGAAGGACCAGAAGGAGCCCAAGAACAAGACCUUCCUGAGAUGCGAGGCC AAGAACUACAGCGGCAGAUUCACCUGCUGGUGGCUGACCACCAUCAGCACAGAUUU GACCUUCAGCGUGAAGAGCAGCAGAGGCAGCAGCGACCCCCAGGGCGUGACCUGCG GCGCCGCCACCCUGAGCGCCGAGAGAGUGAGAGGUGACAACAAGGAGUACGAGUAC AGCGUGGAGUGCCAGGAAGAUAGCGCCUGCCCCGCCGCCGAGGAGAGCCUGCCCAU CGAGGUGAUGGUGGACGCCGUGCACAAGCUGAAGUACGAGAACUACACCAGCAGCU UCUUCAUCAGAGAUAUCAUCAAGCCCGACCCGCGAAGAACCUGCAGCUGAAGCCC CUGAAGAACAGCCGGCAGGUGGAGGUGAGCUGGGAGUACCCCGACACCUGGAGCAC CCCCCACAGCUACUUCAGCCUGACCUUCUGCGUGCAGGUGCAGGGCAAGAGCAAGA GAGAGAAGAAAGAUAGAGUGUUCACAGAUAAGACCAGCGCCACCGUGAUCUGCAGA AAGAACGCCAGCAUCAGCGUGAGAGCCCAAGAUAGAUACUACAGCAGCAGCUGGAG CGAGUGGGCCAGCGUGCCCUGCAGCGGCGGCGGCGGCGGCAGCAGAAACCUGC CCGUGGCCACCCCCGACCCCGGCAUGUUCCCCUGCCUGCACCACAGCCAGAACCUG CUGAGAGCCGUGAGCAACAUGCUGCAGAAGGCCCGGCAGACCCUGGAGUUCUACCC CUGCACCAGCGAGGAGAUCGACCACGAAGAUAUCACCAAAGAUAAGACCAGCACCG UGGAGGCCCUGCCUGCCCCUGGAGCUGACCAAGAAUGAAAGCUGCCUGAACAGCAGA GAGACCAGCUUCAUCACCAACGGCAGCUGCCUGGCCAGCAGAAAGACCAGCUUCAU GAUGGCCCUGUGCCUGAGCAGCAUCUACGAGGACCUGAAGAUGUACCAGGUGGAGU UCAAGACCAUGAACGCCAAGCUGCUGAUGGACCCCAAGCGGCAGAUCUUCCUGGAC CAGAACAUGCUGGCCGUGAUCGACGAGCUGAUGCAGGCCCUGAACUUCAACAGCGA GACCGUGCCCCAGAAGAGCAGCCUGGAGGAGCCCGACUUCUACAAGACCAAGAUCA AGCUGUGCAUCCUGCUGCACGCCUUCAGAAUCAGAGCCGUGACCAUCGACAGAGUG AUGAGCUACCUGAACGCCAGCUGAUAAUAGGCUGGAGCCUCGGUGGCCAUGCUUCU UGCCCCUUGGGCCUCCCCCAGCCCCUCCUCCCCUUCCUGCACCCGUACCCCCAA ACACCAUUGUCACACUCCAGUGGUCUUUGAAUAAAGUCUGAGUGGGCGGCAAAAAA AAAAAAAAAAAAAAAAAAAAAAAAAAAAAAAAAAAAAAAAAAAAAAAAAAAAAAAA AAAAAAAAAAAAAAAAAAAAAAAAAAAAAAAAAAAAAAAAAUCUAG G* = a 5' terminal guanosine cap |
| 147 | hIL12AB_007 (mRNA with T100 tail) | G*GGGAAAUAAGAGAGAAAAGAAGAGUAAGAAGAAAUAUAAGAGCCACCAUGUGCC ACCAGCAGCUUGUCAUCUCCUGGUUCUCUCUUGUCUUCCUUGCUUCUCCUCUUGUG GCCAUCUGGGAGCUGAAGAAGGACGUUUACGUAGUGGAGUUGGAUUGGUACCCUGA CGCACCUGGAGAAAUGGUGGUUCUCACCUGUGACACUCCUGAGGAGGACGGUAUCA CCUGGACGUUGGACCAGUCUUCUGAGGUUCUUGGCAGUGGAAAAACUCUUACUAUU CAGGUGAAGGAGUUUGGAGAUGCUGGCCAGUACACCUGCCACAAGGGUGGUGAAGU UCUCAGCCACAGUUUACUUCUUCUUCACAAGAAGGAGGAUGGCAUCUGGUCUACUG ACAUUUUAAAAGACCAGAAGGAGCCCAAGAACAAAACAUUCCUUCGUUGUGAAGCC AAGAACUACAGUGGUCGUUUCACCUGCUGGUGGCUUACUACUAUUUCUACUGACCU UACUUUCUCGUGAAGUCUUCUCGUGGCUCUUCUGACCCUCAGGGUGUCACCUGUG GGGCUGCUACUCUUUCUGCUGAGCGUGUGCGUGGUGACAACAAGGAGUAUGAAUAC UCGGUGGAGUGCCAGGAAGAUUCUGCCUGCCCUGCUGCUGAGGAGUCUCUUCCUAU UGAGGUGAUGGUGGAUGCUGUGCACAAGUUAAAAUAUGAAAACUACACUUCUUCUU UCUUCAUUCGUGACAUUAUAAAACCUGACCCUCCCAAGAACCUUCAGUUGAAACCU UUAAAAAACUCUCGUCAGGUGGAGGUGUCCUGGGAGUACCCUGACACGUGGUCUAC UCCUCACUCCUACUUCUCUCUUACUUUCUGUGUCCAGGUGCAGGGCAAGUCCAAGC GUGAGAAGAAGGACCGUGUCUUCACUGACAAAACAUCUGCUACUGUCAUCUGCAGG AAGAAUGCAUCCAUCUCUGUGCGUGCUCAGGACCGUUACUACAGCUCUUCCUGGUC UGAGUGGGCUUCUGUGCCCUGCUCUGGCGGCGGCGGCGGCGGCAGCAGAAAUCUUC CUGUGGCUACUCCUGACCCUGGCAUGUUCCCCUGCCUUCACCACUCGCAGAACCUU CUUCGUGCUGUGAGCAACAUGCUUCAGAAGGCUCGUCAAACUUUAGAAUUCUACCC CUGCACUUCUGAGGAGAUUGACCAUGAAGAUAUCACCAAAGAUAAAACAUCUACUG UGGAGGCCUGCCUUCCUUUAGAGCUGACCAAGAAUGAAUCCUGCUUAAAUUCUCGU GAGACGUCUUUCAUCACCAAUGGCAGCUGCCUUGCCUCGCGCAAAACAUCUUUCAU GAUGGCUCUUUGCCUUUCUUCCAUCUAUGAAGAUUUAAAAAUGUACCAGGUGGAGU UCAAGACCAUGAAUGCAAAGCUUCUCAUGGACCCCAAGCGUCAGAUAUUUUUGGAC CAGAACAUGCUUGCUGUCAUUGAUGAGCUCAUGCAGGCUUUAAACUUCAACUCUGA GACGGUGCCUCAGAAGUCUUCUUUAGAAGAGCCUGACUUCUACAAGACCAAGAUAA ACUUUGCAUUCUUCUUCAUGCUUUCCGCAUCCGUGCUGUGACUAUUGACCGUGUG AUGUCCUACUUAAAUGCUUCUUGAUAAUAGGCUGGAGCCUCGGUGGCCAAGCUUCU UGCCCCUUGGGCCUCCCCCAGCCCCUCCUCCCCUUCCUGCACCCGUACCCCCAA ACACCAUUGUCACACUCCAGUGGUCUUUGAAUAAAGUCUGAGUGGGCGGCAAAAAA AAAAAAAAAAAAAAAAAAAAAAAAAAAAAAAAAAAAAAAAAAAAAAAAAAAAAAAA AAAAAAAAAAAAAAAAAAAAAAAAAAAAAAAAAAAAAAAAAUCUAG G* = a 5' terminal guanosine cap |
| 148 | hIL12AB_008 (mRNA with T100 tail) | G*GGGAAAUAAGAGAGAAAAGAAGAGUAAGAAGAAAUAUAAGAGCCACCAUGUGUC AUCAACAACUCGUGAUUAGCUGGUUCAGUCUCGUGUUCCUGGCCUCUCCGCUGGUG GCCAUCUGGGAGCUUAAGAAGGACGUGUACGUGGUGGAGCUCGAUUGGUACCCCGA CGCACCUGGCGAGAUGGUGGUGCUAACCUGCGAUACCCCCGAGGAGGACGGGAUCA CUUGGACCCUGGAUCAGAGUAGCGAAGUCCUGGGCUCUGGCAAAACACUCACAAUC CAGGUGAAGGAAUUCGGAGACGCUGGUCAGUACACUUGCCACAAGGGGGGUGAAGU |

-continued

SUMMARY OF SEQUENCES

| SEQ ID NO | Description | Sequence |
|---|---|---|
| | | GCUGUCUCACAGCCUGCUGUUACUGCACAAGAAGGAGGAUGGGAUCUGGUCAACCG ACAUCCUGAAGGAUCAGAAGGAGCCUAAGAACAAGACCUUUCUGAGGUGUGAAGCU AAGAACUAUUCCGGAAGAUUCACUUGCUGGUGGUUGACCACAAUCAGCACUGACCU GACCUUUUCCGUGAAGUCCAGCAGAGGAAGCAGCGAUCCUCAGGGCGUAACGUGCG GCGCGGCUACCCUGUCAGCUGAGCGGGUUAGAGGCGACAACAAAGAGUAUGAGUAC UCCGUGGAGUGUCAGGAAGAUAGCGCCUGCCCCGCAGCCGAGGAGAGUCUGCCCAU CGAGGUGAUGGUGGACGCUGUCCAUAAGUUAAAAUACGAAAAUUACACAAGUUCCU UUUUCAUCCGCGAUAUUAUCAAACCCGAUCCCCCCAAGAACCUGCAGCUGAAGCCC CUGAAGAAUAGCCGACAGGUGGAAGUCUCUUGGGAGUAUCCUGACACCUGGUCCAC GCCUCACAGCUACUUUAGUCUGACUUUCUGUGUCCAGGUCCAGGGCAAGAGCAAGA GAGAGAAAAAGGAUAGAGUGUUUACUGACAAAACAUCUGCUACAGUCAUCUGCAGA AAGAACGCCAGUAUCUCAGUGAGGGCGCAAGAUAGAUACUACAGUAGUAGCUGGAG CGAAUGGGCUAGCGUGCCCUGUUCAGGGGGCGGCGGAGGGGGCUCCAGGAAUCUGC CCGUGGCCACCCCCGACCCUGGGAUGUUCCCUUGCCUCCAUCACUCACAGAACCUG CUCAGAGCAGUGAGCAACAUGCUCCAAAAGGCCCGCCAGACCCUGGAGUUUUACCC UUGUACUUCAGAAGAGAUCGAUCACGAAGAUAUAACAAAGGAUAAAACCAGCACCG UGGAGGCCUGUCUGCCUCUGGAACUCACAAAGAAUGAAAGCUGUCUGAAUUCCAGG GAAACCUCCUUCAUUACUAACGGAAGCUGUCUCGCAUCUCGCAAAACAUCAUUCAU GAUGGCCCUCUGCCUGUCUUCUAUCUAUGAAGAUCUCAAGAUGUAUCAGGUGGAGU UCAAAACAAUGAACGCCAAGCUGCUGAUGGACCCCAAGCGGCAGAUCUUCCUGGAC CAGAACAUGCUGGCAGUGAUCGAUGAGCUGAUGCAAGCCUUGAACUUCAACUCAGA GACGGUGCCGCAAAAGUCCUCGUUGGAGGAACCAGAUUUUUACAAAACCAAAAUCA AGCUGUGUAUCCUUCUUCACGCCUUUCGGAUCAGAGCCGUGACUAUCGACCGGGUG AUGUCAUACCUGAAUGCUUCCUGAUAAUAGGCUGGAGCCUCGGUGGCCAUGCUUCU UGCCCCUUGGGCCUCCCCCCAGCCCCUCCUCCCCUUCCUGCACCCGUACCCCCCAA ACACCAUUGUCACACUCCAGUGGUCUUUGAAUAAAGUCUGAGUGGGCGGCAAAAAA AAAAAAAAAAAAAAAAAAAAAAAAAAAAAAAAAAAAAAAAAAAAAAAAAAAAAAA AAAAAAAAAAAAAAAAAAAAAAAAAAAAAAAAAAAAAUCUAG G* = a 5' terminal guanosine cap |
| 149 | hIL12AB_009 (mRNA with T100 tail) | G*GGGAAAUAAGAGAGAAAAGAAGAGUAAGAAGAAAUAUAAGAGCCACCAUGUGCC ACCAGCAGCUGGUCAUCAGCUGGUUUAGCCUGGUCUUCCUGGCCAGCCCCCUGGUG GCCAUCUGGGAGCUGAAGAAAGACGUCUACGUAGUAGAGUUGGAUUGGUACCCAGA CGCACCUGGAGAAAUGGUGGUUCUCACCUGCGACACGCCAGAAGAAGACGGUAUCA CCUGGACGCUGGACCAGAGCAGCGAAGUACUGGGCAGUGGAAAAACGCUGACCAUA CAAGUAAAAGAAUUUGGCGAUGCUGGCCAGUACACCUGCCACAAAGGAGGAGAAGU ACUGAGCCACAGCCUGCUGCUGCUGCACAAGAAGGAAGAUGGCAUCUGGAGCACCG ACAUUUUAAAAGACCAGAAGGAGCCCAAGAACAAAACCUUCCUUCGAUGUGAGGCG AAGAACUACAGUGGCCGCUUCACCUGCUGGUGGCUCACCACCAUCAGCACCGACCU CACCUUCUCGGUGAAGAGCAGCCGGGGUAGCUCAGACCCCCAAGGAGUCACCUGUG GGGCGGCCACGCUGUCGGCAGAAAGAGUUCGAGGCGACAACAAGGAAUAUGAAUAC UCGGUGGAAUGUCAAGAAGAUUCGGCCUGCCCGGCGGCAGAAGAAAGUCUGCCCAU AGAAGUCAUGGUGGAUGCUGUUCACAAAUUAAAAUAUGAAAACUACACCAGCAGCU UCUUCAUCAGAGAUAUCAUCAAGCCAGACCCCCCCAAGAACCUGCAGCUGAAGCCC CUGAAGAACAGCCGGCAGGUGGAAGUUUCUGGGAGUACCCAGAUACGUGGAGCAC GCCGCACAGCUACUUCAGCCUCACCUUCUGUGUACAAGUACAAGGCAAGAGCAAGA GAGAGAAGAAAGAUCGUGUCUUCACCGACAAAACCUCGGCGACGGUCAUCUGCAGG AAGAAUGCAAGCAUCUCGGUUCGAGCCCAGGACCGCUACUACAGCAGCAGCUGGAG UGAGUGGGCCUCGGUGCCCUGCAGUGGUGGCGGCGGCGGCAGCAGAAACCUUC CUGUGGCCACGCCGGACCCUGGCAUGUUUCCGUGCCUGCCACCACAGCCAAAAUUUA UUACGAGCUGUUAGCAACAUGCUGCAGAAAGCACGGCAAACUUUAGAAUUCUACCC CUGCACCUCAGAAGAAAUAGACCAUGAAGAUAUCACCAAAGAUAAAACCAGCACUG UAGAGGCCUGCCUGCCCCUGGAGCUCACCAAGAACGAGAGCUGCCUCAAUAGCAGA GAGACCAGCUUCAUCACCAAUGGCAGCUGCCUGGCCAGCAGGAAAACCAGCUUCAU GAUGGCGCUCUGCCUGAGCAGCAUCUAUGAAGAUCUGAAGAUGUACCAAGUAGAAU UUAAAACCAUGAAUGCCAAGCUGCUCAUGGACCCCAAGCGGCAGAUAUUCCUCGAC CAAAACAUGCUGGCUGUCAUUGAUGAGCUCAUGCAAGCAUUAAACUUCAACUCAGA GACGGUGCCCCAGAAGAGCAGCCUGGAGGAGCCAGAUUUCUACAAAACCAAGAUCA AGCUCUGCAUCUUAUUACAUGCCUUCCGCAUCCGGGCGGUCACCAUUGACCGUGUC AUGUCCUACUUAAAUGCCAGCUGAUAAUAGGCUGGAGCCUCGGUGGCCAUGCUUCU UGCCCCUUGGGCCUCCCCCCAGCCCCUCCUCCCCUUCCUGCACCCGUACCCCCCAA ACACCAUUGUCACACUCCAGUGGUCUUUGAAUAAAGUCUGAGUGGGCGGCAAAAAA AAAAAAAAAAAAAAAAAAAAAAAAAAAAAAAAAAAAAAAAAAAAAAAAAAAAAAA AAAAAAAAAAAAAAAAAAAAAAAAAAAAAAAAAAAAAUCUAG G* = a 5' terminal guanosine cap |
| 150 | hIL12AB_010 (mRNA with T100 tail) | G*GGGAAAUAAGAGAGAAAAGAAGAGUAAGAAGAAAUAUAAGAGCCACCAUGUGCC ACCAGCAGCUUGUCAUCUCCUGGUUUUCUCUUGUCUUCCUCGCUUCUCCUCUUGUG GCCAUCUGGGAGCUGAAGAAAGACGUCUACGUAGUAGAGUUGGAUUGGUACCCGGA CGCUCCUGGAGAAAUGGUGGUUCUCACCUGCGACACUCCUGAAGAAGACGGUAUCA CCUGGACGCUGGACCAAAGCAGCGAAGUUUUAGGCUCUGGAAAAACGCUGACCAUA CAAGUAAAAGAAUUUGGCGACGCUGGCCAGUACACGUGCCACAAAGGAGGAGAAGU UUUAAGCCACAGUUUACUUCUUCUUCACAAGAAAGAAGAUGGCAUCUGGAGUACAG |

| SEQ ID NO | Description | Sequence |
|---|---|---|
| | | AUAUUUUAAAAGACCAGAAGGAGCCUAAGAACAAAACCUUCCUCCGCUGUGAAGCU AAGAACUACAGUGGUCGUUUCACCUGCUGGUGGCUCACCACCAUCUCCACUGACCU CACCUUCUCUGUAAAAUCAAGCCGUGGUUCUUCUGACCCCCAAGGAGUCACCUGUG GGGCUGCCACGCUCAGCGCUGAAAGAGUUCGAGGCGACAACAAGGAAUAUGAAUAU UCUGUGGAAUGUCAAGAAGAUUCUGCCUGCCCGGCGGCAGAAGAAAGUCUUCCCAU AGAAGUCAUGGUGGACGCUGUUCACAAAUUAAAAUAUGAAAACUACACCAGCAGCU UCUUCAUUCGUGACAUCAUCAAACCAGACCCUCCUAAGAACCUUCAGUUAAAACCG CUGAAGAACAGCCGGCAGGUGGAAGUUUCCUGGGAGUACCCAGAUACGUGGAGUAC GCCGCACUCCUACUUCAGUUUAACCUUCUGUGUACAAGUACAAGGAAAAUCAAAAA GAGAGAAGAAAGAUCGUGUCUUCACUGACAAAACAUCUGCCACGGUCAUCUGCCGU AAGAACGCUUCCAUCUCGGUUCGAGCCCAGGACCGCUACUACAGCAGCAGCUGGAG UGAGUGGGCAUCUGUUCCCUGCAGUGGUGGCGGCGGCGGCGGCAGCCGCAACCUUC CUGUGGCCACGCCGGACCCUGGCAUGUUCCCGUGCCUUCACCACUCGCAAAAUCUU CUUCGUGCUGUUUCUAACAUGCUGCAGAAGGCGCGGCAAACUUUAGAAUUCUACCC GUGCACUUCUGAAGAAAUAGACCAUGAAGAUAUCACCAAAGAUAAAACCAGCACGG UGGAGGCCUGCCUUCCUUUAGAACUUACUAAGAACGAAAGUUGCCUUAACAGCCGU GAGACCAGCUUCAUCACCAAUGGCAGCUGCCUUGCUAGCAGGAAGACCAGCUUCAU GAUGGCGCUGUGCCUUUCUUCCAUCUAUGAAGAUCUUAAGAUGUACCAAGUAGAAU UUAAAACCAUGAAUGCCAAAUUAUUAAUGGACCCCAAGCGGCAGAUAUUCCUCGAC CAAAACAUGCUGGCUGUCAUUGAUGAGCUCAUGCAAGCAUUAAACUUCAACUCAGA AACUGUUCCCCAGAAGUCAUCUUUAGAAGAACCAGAUUUCUACAAAACAAAAAUAA AACUCUGCAUUCUUCUUCAUGCCUUCCGCAUCCGUGCUGUCACCAUUGACCGUGUC AUGUCCUACUUAAAUGCUUCUUGAUAAUAGGCUGGAGCCUCGGUGGCCAUGCUUCU UGCCCCUUGGGCCUCCCCCCAGCCCCUCCUCCCCUUCCUGCACCCGUACCCCCCAA ACACCAUUGUCACACUCCAGUGGUCUUUGAAUAAAGUCUGAGUGGGCGGCAAAAAA AAAAAAAAAAAAAAAAAAAAAAAAAAAAAAAAAAAAAAAAAAAAAAAAAAAAAAAA AAAAAAAAAAAAAAAAAAAAAAAAAAAAAAAAAAAAAAAUCUAG G* = a 5' terminal guanosine cap |
| 151 | hIL12AB_011 (mRNA with T100 tail) | G*GGGAAAUAAGAGAGAAAAGAAGAGUAAGAAGAAAUAUAAGAGCCACCAUGUGCC ACCAGCAGCUGGUGAUCAGCUGGUUCAGCCUGGUGUUCCUGGCCAGCCCCCUGGUG GCCAUCUGGGAGCUGAAGAAGGACGUGUACGUGGUGGAGUUGGAUUGGUACCCGGA CGCGCCGGGGGAGAUGGUGGUGCUGACGUGCGACACGCCGGAGGAGGACGGGAUCA CGUGGACGCUGGACCAGAGCAGCGAGGUGCUGGGGAGCGGGAAGACGCUGACGAUC CAGGUGAAGGAGUUCGGGGACGCGGGGCAGUACACGUGCCACAAGGGGGGGGAGGU GCUGAGCCACAGCCUGCUGCUGCUGCACAAGAAGGAGGACGGGAUCUGGAGCACAG AUAUCCUGAAGGACCAGAAGGAGCCGAAGAACAAGACGUUCCUGAGGUGCGAGGCG AAGAACUACAGCGGGAGGUUCACGUGCUGGUGGCUGACGACGAUCAGCACGGACCU GACGUUCAGCGUGAAGAGCAGCAGGGGGAGCAGCGACCCGCAGGGGGUGACGUGCG GGGCGGCGACGCUGAGCGCGGAGAGGGUGAGGGGUGACAACAAGGAGUACGAGUAC AGCGUGGAGUGCCAGGAAGAUAGCGCGUGCCCGGCGGCGGAGGAGAGCCUGCCGAU CGAGGUGAUGGUGGACGCGGUGCACAAGCUGAAGUACGAGAACUACACGAGCAGCU UCUUCAUCAGAGAUAUCAUCAAGCCGGACCCGCCGAAGAACCUGCAGCUGAAGCCG CUGAAGAACAGCAGGCAGGUGGAGGUGAGCUGGGAGUACCCAGAUACGUGGAGCAC GCCGCACAGCUACUUCAGCCUGACGUUCUGCGUGCAGGUGCAGGGGAAGAGCAAGA GGGAGAAGAAAGAUAGGGUGUUCACAGAUAAGACGAGCGCGACGGUGAUCUGCAGG AAGAACGCGAGCAUCAGCGUGAGGGCGCAAGAUAGGUACUACAGCAGCAGCUGGAG CGAGUGGGCGAGCGUGCCGUGCAGCGGGGGGGGGGGGGGGAGCAGGAACCUGC CGGUGGCGACGCCGGACCCGGGGAUGUUCCCGUGCCUGCACCACAGCCAGAACCUG CUGAGGGCGGUGAGCAACAUGCUGCAGAAGGCGAGGCAGACGCUGGAGUUCUACCC GUGCACGAGCGAGGAGAUCGACCACGAAGAUAUCACGAAAGAUAAGACGAGCACGG UGGAGGCGUGCCUGCCGCUGGAGCUGACGAAGAACGAGAGCUGCCUGAACAGCAGG GAGACGAGCUUCAUCACGAACGGGAGCUGCCUGGCGAGCAGGAAGACGAGCUUCAU GAUGGCGCUGUGCCUGAGCAGCAUCUACGAGGACCUGAAGAUGUACCAGGUGGAGU UCAAGACGAUGAACGCGAAGCUGCUGAUGGACCCGAAGAGGCAGAUCUUCCUGGAC CAGAACAUGCUGGCGGUGAUCGACGAGCUGAUGCAGGCGCUGAACUUCAACAGCGA GACGGUGCCGCAGAAGAGCAGCCUGGAGGAGCCAGAUUUCUACAAGACGAAGAUCA AGCUGUGCAUCCUGCUGCACGCGUUCAGGAUCAGGGCGGUGACGAUCGACAGGGUG AUGAGCUACCUGAACGCGAGCUGAUAAUAGGCUGGAGCCUCGGUGGCCAUGCUUCU UGCCCCUUGGGCCUCCCCCCAGCCCCUCCUCCCCUUCCUGCACCCGUACCCCCCAA ACACCAUUGUCACACUCCAGUGGUCUUUGAAUAAAGUCUGAGUGGGCGGCAAAAAA AAAAAAAAAAAAAAAAAAAAAAAAAAAAAAAAAAAAAAAAAAAAAAAAAAAAAAAA AAAAAAAAAAAAAAAAAAAAAAAAAAAAAAAAAAAAAAAUCUAG G* = a 5' terminal guanosine cap |
| 152 | hIL12AB_012 (mRNA with T100 tail) | G*GGGAAAUAAGAGAGAAAAGAAGAGUAAGAAGAAAUAUAAGAGCCACCAUGUGCC AUCAGCAGCUGGUGAUCAGCUGGUUCAGCCUCGUGUUUCUGGCCAGCCCCCUGGUG GCCAUUUGGGAACUCAAGAAGGACGUGUACGUUGUGGAACUCGACUGGUACCCUGA CGCCCCAGGCGAAAUGGUGGUCUUAACCUGCGACACCCCUGAGGAGGACGGAAUCA CCUGGACCUUGGACCAGAGCUCCGAGGUCCUCGGCAGUGGCAAGACCCUGACCAUA CAGGUGAAGGAAUUUGGAGACGCAGGGCAAUACACAUGUCACAAGGGCGGGGAGGU UCUUUCUCACUCCCUUCUGCUUCUACAUAAAAGGAAGACGGAAUUUGGUCUACCG ACAUCCUCAAGGACCAAAAGGAGCCUAAGAAUAAAACCUUCUUACGCUGUGAAGCU |

| SEQ ID NO | Description | Sequence |
|---|---|---|
| | | AAAAACUACAGCGGCAGAUUCACUUGCUGGUGGCUCACCACCAUUUCUACCGACCU<br>GACCUUCUCGGUGAAGUCUUCAAGGGGCUCUAGUGAUCCACAGGGAGUGACAUGCG<br>GGGCCGCCACACUGAGCGCUGAACGGGUGAGGGGCGAUAACAAGGAGUAUGAAUAC<br>UCUGUCGAGUGUCAGGAGGAUUCAGCUUGUCCCGCAGCUGAAGAGUCACUCCCCAU<br>AGAGGUUAUGGUCGAUGCUGUGCAUAAACUGAAGUACGAAAACUACACCAGCAGCU<br>UCUUCAUUAGAGAUAUUAUAAAACCUGACCCCCCAAGAACCUGCAACUUAAACCC<br>CUGAAAAACUCUCGGCAGGUCGAAGUUAGCUGGGAGUACCCUGAUACUUGGUCCAC<br>CCCCCACUCGUACUUCUCACUGACUUUCUGUGUGCAGGUGCAGGGCAAGAGCAAGA<br>GAGAGAAAAAAGAUCGUGUAUUCACAGAUAAGACCUCUGCCACCGUGAUCUGCAGA<br>AAAAACGCUUCCAUCAGUGUCAGAGCCCAAGACCGGUACUAUAGUAGUAGCUGGAG<br>CGAGUGGGCAAGUGUCCCCUGCUCUGGCGGCGGAGGGGCGGCUCUCGAAACCUCC<br>CCGUCGCUACCCCUGAUCCAGGAAUGUUCCCUUGCCUGCAUCACUCACAGAAUCUG<br>CUGAGAGCGGUCAGCAACAUGCUGCAGAAAGCUAGGCAAACACUGGAGUUUUAUCC<br>UUGUACCUCAGAGGAGAUCGACCACGAGGAUAUUACCAAAGAUAAGACCAGCACGG<br>UGGAGGCCUGCUUGCCCCUGGAACUGACAAAGAAUGAAUCCUGCCUUAAUAGCCGU<br>GAGACCUCUUUUAUAACAAACGGAUCCUGCCUGGCCAGCAGGAAGACCUCCUUCAU<br>GAUGGCCCUCUGCCUGUCCUCAAUCUACGAAGACCUGAAGAUGUACCAGGUGGAAU<br>UUAAAACUAUGAACGCCAAGCUGUUGAUGGACCCCAAGCGGCAGAUCUUUCUGGAU<br>CAAAAUAUGCUGGCUGUGAUCGACGAACUGAUGCAGGCCCUCAACUUUAACAGCGA<br>GACCGUGCCACAAAAGAGCAGUCUUGAGGACCCGACUUCUACAAGACCAAGAUCA<br>AGCUGUGCAUCCUCCUUCAUGCCUUCAGGAUAAGAGCUGUCACCAUCGACAGAGUC<br>AUGAGUUACCUGAAUGCAUCCUGAUAAUAGGCUGGAGCCUCGGUGGCCAUGCUUCU<br>UGCCCCUUGGGCCUCCCCCAGCCCCUCCUCCCCUUCCUGCACCCGUACCCCCCAA<br>ACACCAUUGUCACACUCCAGUGGUCUUUGAAUAAAGUCUGAGUGGGCGGCAAAAAA<br>AAAAAAAAAAAAAAAAAAAAAAAAAAAAAAAAAAAAAAAAAAAAAAAAAAAAAAA<br>AAAAAAAAAAAAAAAAAAAAAAAAAAAAAAAAAAAAAAAUCUAG G* = a 5'<br>terminal guanosine cap |
| 153 | hIL12AB_013<br>(mRNA with<br>T100 tail) | G*GGGAAAUAAGAGAGAAAAGAAGAGUAAGAAGAAAUAUAAGAGCCACCAUGUGCC<br>ACCAGCAGCUGGUCAUCUCCUGGUUCAGUCUUGUCUUCCUGGCCUCGCCGCUGGUG<br>GCCAUCUGGGAGCUGAAGAAAGACGUUUACGUAGUAGAGUUGGAUUGGUACCCAGA<br>CGCACCUGGAGAAAUGGUGGUCCUCACCUGUGACACGCCAGAAGAAGACGGUAUCA<br>CCUGGACGCUGGACCAGAGCAGUGAAGUUCUUGGAAGUGGAAAAACGCUGACCAUA<br>CAAGUAAAAGAAUUUGGAGAUGCUGGCCAGUACACCUGCCACAAAGGAGGAGAAGU<br>UCUCAGCCACAGUUUAUUAUUACUUCACAAGAAAGAAGAUGGCAUCUGGUCCACAG<br>AUAUUUUAAAAGACCAGAAGGAGCCCAAAAAUAAAACAUUUCUUCGAUGUGAGGCC<br>AAGAACUACAGUGGUCGUUUCACCUGCUGGUGGCUGACCACCAUCUCCACAGACCU<br>CACCUUCAGUGUAAAAGCAGCCGUGGUUCUUCUGACCCCCAAGGAGUCACCUGUG<br>GGGCUGCCACGCUCUCUGCAGAAAGAGUUCGAGGUGACAACAAAGAAUAUGAGUAC<br>UCGGUGGAAUGUCAAGAAGAUUCGGCCUGCCCAGCUGCUGAGGAGAGUCUUCCCAU<br>AGAAGUCAUGGUGGAUGCUGUUCACCAAAUUAAAAAUAUGAAAACUACACCAGCAGCU<br>UCUUCAUCAGAGAUAUCAUCAAACCUGACCCGCCCAAGAACUUACAGCUGAAGCCG<br>CUGAAAAACAGCCGGCAGGUAGAAGUUUCCUGGGAGUACCCAGAUACCUGGUCCAC<br>GCCGCACUCCUACUUCUCCCUCACCUUCUGUGUACAAGUACAAGGCAAGAGCAAGA<br>GAGAGAAGAAAGAUCGUGUCUUCACAGAUAAAACAUCAGCCACGGUCAUCUGCAGG<br>AAAAAUGCCAGCAUCUCGGUGCGGGCCCAGGACCGCUACUACAGCAGCAGCUGGAG<br>UGAGUGGGCAUCUGUGCCCUGCAGUGGUGGUGGGGUGGUGGCAGCAGAAACCUUC<br>CUGUGGCCACUCCAGACCCUGGCAUGUUCCCGUGCCUUCACCACUCCCAAAAUUUA<br>CUUCGAGCUGUUUCUAACAUGCUGCAGAAAGCACGGCAAACUUUAGAAUUCUACCC<br>GUGCACUUCUGAAGAAAUUGACCAUGAAGAUAUCACAAAAGAUAAAACCAGCACAG<br>UGGAGGCCUGUCUUCCUUUAGAGCUGACCAAAAAUGAAUCCUGCCUCAACAGCAGA<br>GAGACCAGCUUCAUCACCAAUGGCAGCUGCCUGGCCUCCAGGAAAACCAGCUUCAU<br>GAUGGCGCUCUGCCUCAGCUCCAUCUAUGAAGAUUUGAAGAUGUACCAAGUAGAAU<br>UUAAAACCAUGAAUGCCAAAUUAUUAAUGGACCCCAAGAGGCAGAUAUUUUUAGAU<br>CAAAACAUGCUGGCAGUUAUUGAUGAGCUCAUGCAAGCAUUAAACUUCAACAGUGA<br>GACGGUACCUCAAAAAAGCAGCCUUGAAGAGCCAGAUUUCUACAAAACCAAGAUCA<br>AACUCUGCAUUUUACUUCAUGCCUUCCGCAUCCGGGCGGUCACCAUUGACCGUGUC<br>AUGUCCUACUUAAAUGCCUCGUGAUAAUAGGCUGGAGCCUCGGUGGCCAUGCUUCU<br>UGCCCCUUGGGCCUCCCCCAGCCCCUCCUCCCCUUCCUGCACCCGUACCCCCCAA<br>ACACCAUUGUCACACUCCAGUGGUCUUUGAAUAAAGUCUGAGUGGGCGGCAAAAAA<br>AAAAAAAAAAAAAAAAAAAAAAAAAAAAAAAAAAAAAAAAAAAAAAAAAAAAAAA<br>AAAAAAAAAAAAAAAAAAAAAAAAAAAAAAAAAAAAAAAUCUAG G* = a 5'<br>terminal guanosine cap |
| 154 | hIL12AB_014<br>(mRNA with<br>T100 tail) | G*GGGAAAUAAGAGAGAAAAGAAGAGUAAGAAGAAAUAUAAGAGCCACCAUGUGCC<br>ACCAGCAGCUUGUGAUUUCUGGUUCUCUCUUGUGUUCCUUGCUUCUCCUCUUGUG<br>GCUAUUUGGGAGUUAAAAAAGGACGUGUACGUGGUGGAGCUUGACUGGUACCCUGA<br>CGCACCUGGCGAGAUGGUGGUGCUUACUUGUGACACUCCUGAGGAGGACGGCAUUA<br>CUUGGACGCUUGACCAGUCUUCUGAGGUGCUUGGCUCUGGCAAAACACUUACUAUU<br>CAGGUGAAGGAGUUCGGGGAUGCUGGCCAGUACACUUGCCACAAGGGCGGCGAGGU<br>GCUUUCUCACUCUCUUCUUCUUCACAAGAAGGAGGACGGCAUUUGGUCUACUG<br>ACAUUUUAAAAGACCAGAAGGAGCCCAAGAACAAAACAUUCCUUCGUUGCGAGGCC<br>AAGAACUACUCUGGCCGUUUCACUUGCUGGUGGCUUACUACUAUUUCUACUGACCU |

SUMMARY OF SEQUENCES

| SEQ ID NO | Description | Sequence |
|---|---|---|
| | | UACUUUCUCGUGAAGUCUUCUCGUGGCUCUUCUGACCCUCAGGGCGUGACUUGUG<br>GGGCUGCUACUCUUUCUGCUGAGCGUGUGCGUGGUGACAACAAGGAGUACGAGUAC<br>UCUGUGGAGUGCCAGGAAGAUUCUGCUUGCCCUGCUGCUGAGGAGUCUCUUCCUAU<br>UGAGGUGAUGGUGGAUGCUGUGCACAAGUUAAAAUACGAGAACUACACUUCUUCUU<br>UCUUCAUUCGUGACAUUAUUAAGCCUGACCCUCCCAAGAACCUUCAGUUAAAACCU<br>UUAAAAAACUCUCGUCAGGUGGAGGUGUCUUUGGGAGUACCCUGACACUUGGUCUAC<br>UCCUCACUCUUACUUCUCUCUUACUUUCUGCGUGCAGGUGCAGGGCAAGUCUAAGC<br>GUGAGAAGAAGGACCGUGUGUUCACUGACAAAACAUCUGCUACUGUGAUUUGCAGG<br>AAGAAUGCAUCUAUUUCUGUGCGUGCUCAGGACCGUUACUACUCUUCUUCUUGGUC<br>UGAGUGGGCUUCUGUGCCUUGCUCUGGCGGCGGCGGCGGCGGCUCCAGAAAUCUUC<br>CUGUGGCUACUCCUGACCCUGGCAUGUUCCCUUGCCUUCACCACUCUCAGAACCUU<br>CUUCGUGCUGUGAGCAACAUGCUUCAGAAGGCUCGUCAAACUCUUGAGUUCUACCC<br>UUGCACUUCUGAGGAGAUUGACCACGAAGAUAUCACCAAAGAUAAAACAUCUACUG<br>UGGAGGCUUGCCUUCCUCUUGAGCUUACCAAGAAUGAAUCUUGCUUAAAUUCUCGU<br>GAGACGUCUUUCAUCACCAACGGCUCUUGCCUUGCCUCGCGCAAAACAUCUUUCAU<br>GAUGGCUCUUUGCCUUUCUUCUAUUUACGAAGAUUUAAAAAUGUACCAGGUGGAGU<br>UCAAAACAAUGAAUGCAAAGCUUCUUAUGGACCCCAAGCGUCAGAUUUUCCUUGAC<br>CAGAACAUGCUUGCUGUGAUUGACGAGCUUAUGCAGGCUUUAAAUUUCAACUCUGA<br>GACGGUGCCUCAGAAGUCUUCUCUUGAGGAGCCUGACUUCUACAAGACCAAGAUUA<br>AGCUUUGCAUUCUUCUUCAUGCUUUCCGUAUUCGUGCUGGACUAUUGACCGUGUG<br>AUGUCUUACUUAAAUGCUUCUUGAUAAUAGGCUGGAGCCUCGGUGGCCAUGCUUCU<br>UGCCCCUUGGGCCUCCCCCCAGCCCCUCCUCCCCUUCCUGCACCCGUACCCCCCAA<br>ACACCAUUGUCACACUCCAGUGGUCUUUGAAUAAAGUCUGAGUGGGCGGCAAAAAA<br>AAAAAAAAAAAAAAAAAAAAAAAAAAAAAAAAAAAAAAAAAAAAAAAAAAAAAAAA<br>AAAAAAAAAAAAAAAAAAAAAAAAAAAAAAAAAAAAAAAAAUCUAG G* = a 5'<br>terminal guanosine cap |
| 155 | hIL12AB_015 (mRNA with T100 tail) | G*GGGAAAUAAGAGAGAAAAGAAGAGUAAGAAGAAAUAUAAGAGCCACCAUGUGUC<br>ACCAGCAGCUGGUGAUCAGCUGGUUUAGCCUGGUGUUUCUGGCCAGCCCCCUGGUG<br>GCCAUCUGGGAACUGAAGAAAGACGUGUACGUGGUAGAACUGGAUUGGUACCCGGA<br>CGCUCCCGGCGAAAUGGUGGUGCUGACCUGUGACACCCCCGAAGAAGACGGAAUCA<br>CCUGGACCCUGGACCAGAGCAGCGAGGUGCUGGGCAGCGGCAAAACCCUGACCAUC<br>CAAGUGAAAGAGUUUGGCGAUGCCGGCCAGUACACCUGUCACAAAGGCGGCGAGGU<br>GCUAAGCCAUUCGCUGCUGCUGCUGCACAAAAAGGAAGAUGGCAUCUGGAGCACCG<br>AUAUCCUGAAGGACCAGAAAGAACCCAAAAAUAAGACCUUUCUAAGAUGCGAGGCC<br>AAGAAUUAUAGCGGCCGUUUCACCUGCUGGUGGCUGACGACCAUCAGCACCGAUCU<br>GACCUUCAGCGUGAAAAGCAGCAGAGGCAGCAGCGACCCCCAAGGCGUGACGUGCG<br>GCGCCGCCACCCUGAGCGCCGAGAGAGUGAGAGGCGACAACAAGGAGUAUGAGUAC<br>AGCUGGAGUGCCAGGAAGAUAGCGCCUGCCCCGCCGCCGAGGAGAGCCUGCCCAU<br>CGAGGUGAUGGUGGAUGCCGUGCACAAGCUGAAGUAUGAAAACUACACCAGCAGCU<br>UCUUCAUCAGAGAUAUCAUCAAACCCGACCCCCCCAAGAACCUGCAGCUGAAGCCC<br>CUGAAGAAUAGCCGGCAGGUGGAGGUGAGCUGGGAGUACCCCGACACCUGGAGCAC<br>CCCCCAUAGCUACUUCAGCCUGACCUUCUGCGUGCAGGUGCAGGGCAAGAGCAAGA<br>GAGAAAAGAAAGAUAGAGUGUUCACAGAUAAGACCAGCGCCACGGUGAUCUGCAGA<br>AAAAAAUGCCAGCAUCAGCGUGAGAGCCCAAGAUAGAUACUAUAGCAGCAGCUGGAG<br>CGAAUGGGCCAGCGUGCCCUGCAGCGGCGGCGGCGGCGGCAGCAGAAACCUGC<br>CCGUGGCCACCCCCGACCCCGGCAUGUUCCCUGCCUGCACCAGCCAAAACCUG<br>CUGAGAGCCGUGAGCAACAUGCUGCAGAAGGCCCGGCAGACCCUGGAAUUUUACCC<br>CUGCACCAGCGAAGAGAUCGAUCAUGAAGAUAUCACCAAAGAUAAAACCAGCACCG<br>UGGAGGCCUGUCUGCCCCUGGAACUGACCAAGAAUGAGAGCUGCCUAAAUAGCAGA<br>GAGACCAGCUUCAUAACCAAUGGCAGCUGCCUGGCCAGCAGAAAGACCAGCUUUAU<br>GAUGGCCCUGUGCCUGAGCAGCAUCUAUGAAGACCUGAAGAUGUACCAGGUGGAGU<br>UCAAGACCAUGAAUGCCAAGCUGCUGAUGGAUCCCAAGCGGCAGAUCUUUCUGGAU<br>CAAAACAUGCUGGCCGUGAUCGAUGAGCUGAUGCAGGCCCUGAAUUUCAACAGCGA<br>GACCGUGCCCCAAAAAAGCAGCCUGGAAGAACCGGAUUUUUAUAAAACCAAAAUCA<br>AGCUGUGCAUACUGCUGCAUGCCUUCAGAAUCAGAGCCGUGACCAUCGAUAGAGUG<br>AUGAGCUAUCUGAAUGCCAGCUGAUAAUAGGCUGGAGCCUCGGUGGCCAUGCUUCU<br>UGCCCCUUGGGCCUCCCCCCAGCCCCUCCUCCCCUUCCUGCACCCGUACCCCCCAA<br>ACACCAUUGUCACACUCCAGUGGUCUUUGAAUAAAGUCUGAGUGGGCGGCAAAAAA<br>AAAAAAAAAAAAAAAAAAAAAAAAAAAAAAAAAAAAAAAAAAAAAAAAAAAAAAAA<br>AAAAAAAAAAAAAAAAAAAAAAAAAAAAAAAAAAAAAAAUCUAG G* = a 5'<br>terminal guanosine cap |
| 156 | hIL12AB_016 (mRNA with T100 tail) | G*GGGAAAUAAGAGAGAAAAGAAGAGUAAGAAGAAAUAUAAGAGCCACCAUGUGCC<br>ACCAGCAGCUGGUCAUCAGCUGGUUCAGCCUGGUCUUCCUGGCCAGCCCCCUGGUG<br>GCCAUCUGGGAGCUGAAGAAGGACGUAUACGUAGUGGAGUUGGAUUGGUACCCAGA<br>CGCUCCUGGGGAGAUGGUGGUGCUGACCUGUGACACCCCAGAAGAGGACGGUAUCA<br>CCUGGACCCUGGACCAGAGCUCAGAAGUGCUGGGCAGUGGAAAAACCCUGACCAUC<br>CAGGUGAAGGAGUUUGGAGAUGCUGGCCAGUACACCUGCCACAAGGGUGGUGAAGU<br>GCUGAGCCACAGCCUGCUGCUGCUGCACAAGAAGGAGGAUGGCAUCUGGAGCACAG<br>AUAUCCUGAAGGACCAGAAGGAGCCCAAGAACAAGACCUUCCUUCGCUGUGAAGCC<br>AAGAACUACAGUGGCCGCUUCACCUGCUGGUGGCUGACCACCAUCAGCACAGACCU<br>CACCUUCUCGGUGAAGAGCAGCAGAGGCAGCUCAGACCCCCAGGGUGUCACCUGUG |

| SEQ ID NO | Description | Sequence |
|---|---|---|
| | | GGGCGGCCACGCUGUCGGCGGAGAGAGUUCGAGGUGACAACAAGGAGUAUGAAUAC<br>UCGGUGGAGUGCCAGGAAGAUUCGGCGUGCCCGGCGGCAGAAGAGAGCCUGCCCAU<br>AGAAGUGAUGGUGGAUGCUGUGCACAAGCUGAAGUAUGAAAACUACACCAGCAGCU<br>UCUUCAUCAGAGAUAUCAUCAAGCCAGACCCGCCCAAGAACCUGCAGCUGAAGCCC<br>CUGAAGAACAGCCGGCAGGUGGAGGUUUCCUGGGAGUACCCAGAUACGUGGAGCAC<br>CCCCCACAGCUACUUCAGCCUGACCUUCUGUGUCCAGGUGCAGGGCAAGAGCAAGA<br>GAGAGAAGAAAGAUAGAGUCUUCACAGAUAAGACCUCGGCCACGGUCAUCUGCAGA<br>AAGAAUGCCUCCAUCUCGGUUCGAGCCCAAGAUAGAUACUACAGCAGCAGCUGGUC<br>AGAAUGGGCCUCGGUGCCCUGCAGUGGUGGCGGCGGCGGCGGCAGCAGAAACCUGC<br>CUGUUGCCACCCCAGACCCUGGGAUGUUCCCCUGCCUGCACCACAGCCAGAACUUA<br>UUACGAGCUGUUUCUAACAUGCUGCAGAAGGCCCGGCAGACCCUGGAGUUCUACCC<br>CUGCACCUCAGAAGAGAUUGACCAUGAAGAUAUCACCAAAGAUAAGACCAGCACUG<br>UAGAGGCCUGCCUGCCCCUGGAGCUGACCAAGAAUGAAAGCUGCCUGAACAGCAGA<br>GAGACCAGCUUCAUCACCAAUGGAAGCUGCCUGGCCAGCAGAAAGACCAGCUUCAU<br>GAUGGCCCUGUGCCUGAGCAGCAUCUAUGAAGACCUGAAGAUGUACCAGGUGGAGU<br>UCAAGACCAUGAAUGCAAAGCUGCUGAUGGACCCCAAGCGGCAGAUAUUUUUGGAC<br>CAGAACAUGCUGGCUGUCAUUGAUGAGCUGAUGCAGGCCCUGAACUUCAACUCAGA<br>AACUGUACCCCAGAAGAGCAGCCUGGAGGAGCCAGAUUUCUACAAGACCAAGAUCA<br>AGCUGUGCAUCCUGCUUCAUGCUUUCAGAAUCAGAGCUGUCACCAUUGACCGCGUG<br>AUGAGCUACUUAAAUGCCUCGUGAUAAUAGGCUGGAGCCUCGGUGGCCAUGCUUCU<br>UGCCCCUUGGGCCUCCCCCCAGCCCCUCCUCCCCUUCCUGCACCCGUACCCCCCAA<br>ACACCAUUGUCACACUCCAGUGGUCUUUGAAUAAAGUCUGAGUGGGCGGCAAAAAA<br>AAAAAAAAAAAAAAAAAAAAAAAAAAAAAAAAAAAAAAAAAAAAAAAAAAAAAAAA<br>AAAAAAAAAAAAAAAAAAAAAAAAAAAAAAAAAAAAAAAAAUCUAG G* = a 5'<br>terminal guanosine cap |
| 157 | hIL12AB_017<br>(mRNA with<br>T100 tail) | G*GGGAAAUAAGAGAGAAAAGAAGAGUAAGAAGAAAUAUAAGAGCCACCAUGUGCC<br>ACCAGCAGCUGGUAAUCAGCUGGUUUUCCCUCGUCUUUCUGGCAUCACCCCUGGUG<br>GCUAUCUGGGAGCUGAAGAAGGACGUGUACGUGGUGGAGCUGGAUUGGUACCCUGA<br>CGCCCCGGGGGAAAUGGUGGUGUUAACCUGCGACACGCCUGAGGAGGACGGCAUCA<br>CCUGGACGCUGGACCAGAGCAGCGAGGUGCUUGGGUCUGGUAAAACUCUGACUAUU<br>CAGGUGAAAGAGUUCGGGGAUGCCGGCCAAUAUACUUGCCACAAGGGUGGCGAGGU<br>GCUUUCUCAUUCUCUGCUCCUGCUGCACAAGAAAGAAGAUGGCAUUUGGUCUACUG<br>AUAUUCUGAAAGACCAGAAGGAGCCCAAGAACAAGACCUUUCUGAGAUGCGAGGCU<br>AAAAACUACAGCGGAAGAUUUACCUGCUGGUGGCUGACCACAAUCUCAACCGACCU<br>GACAUUUUCAGUGAAGUCCAGCAGAGGGAGCUCCGACCCUCAGGGCGUGACCUGCC<br>GAGCCGCCACUCUGUCCGCAGAAAGAGUGAGAGGUGAUAAUAAGGAGUACGAGUAU<br>UCAGUCGAGUGCCAAGAAGAUUCUGCCUGCCCAGCCGCCGAGGAGAGCCUGCCAAU<br>CGAGGUGAUGGUAGAUGCGGUACACAAGCUGAAGUAUGAGAACUACACAUCCUCCU<br>UCUUCAUAAGAGAUAUUAUCAAGCCUGACCCACCUAAAAAUCUGCAACUCAAGCCU<br>UUGAAAAAUUCACGGCAGGUGGAGGUGACUGGGAGUACCCUGAUACUUGGAGCAC<br>CCCCCAUAGCUACUUUUCGCUGACAUUCUGCGUCCAGGUGCAGGGCAAGUCAAAGA<br>GAGAGAAGAAGGAUCGCGUGUUCACUGAUAAAACAAGCGCCACAGUGAUCUGCAGA<br>AAAAACGCUAGCAUUAGCGUCAGAGCACAGGACCGGUAUUACUCCAGCUCCUGGAG<br>CGAAUGGGCAUCUGUGCCCUGCAGCGGUGGGGCGGAGGCGGAUCCAGAAACCUCC<br>CCGUUGCCACACCUGAUCCUGGAAUGUUCCCCUGUCUGCACCACAGCCAGAACCUG<br>CUGAGAGCAGUGCUAACAUGCUCCAGAAGGCCAGGCAGACCCUGGAGUUUUACCC<br>CUGCACCAGCGAGGAAAUCGAUCACGAAGAUAUCACCAAAGAUAAAACCUCCACCG<br>UGGAGGCCUGCCUGCCCCUGGAACUGACCAAAAACGAGAGCUGCCUGAAUAGCAGG<br>GAGACCUCCUUCAUCACCAACGGCUCAUGCCUUGCCAGCCGGAAAACUAGCUUCAU<br>GAUGGCCCUGUGCCUGUCUUCGAUCUAUGAGGACCUGAAAAUGUACCAGGUCGAAU<br>UUAAGACGAUGAACGCAAAGCUGCUGAUGGACCCCAAGCGGCAGAUCUUUCUGGAC<br>CAGAACAUGCUGGCAGUCAUAGAUGAGUUGAUGCAGGCAUUAAACUUCAACAGCGA<br>GACCGUGCCUCAGAAGUCCAGCCUCGAGGAGCCAGAUUUUUAUAAGACCAAGAUCA<br>AACUAUGCAUCCUGCUGCAUGCUUUCAGGAUUAGAGCCGUCACCAUCGAUCGAGUC<br>AUGUCUUACCUGAAUGCUAGCUGAUAAUAGGCUGGAGCCUCGGUGGCCAUGCUUCU<br>UGCCCCUUGGGCCUCCCCCCAGCCCCUCCUCCCCUUCCUGCACCCGUACCCCCCAA<br>ACACCAUUGUCACACUCCAGUGGUCUUUGAAUAAAGUCUGAGUGGGCGGCAAAAAA<br>AAAAAAAAAAAAAAAAAAAAAAAAAAAAAAAAAAAAAAAAAAAAAAAAAAAAAAAA<br>AAAAAAAAAAAAAAAAAAAAAAAAAAAAAAAAAAAAAAAAAUCUAG G* = a 5'<br>terminal guanosine cap |
| 158 | hIL12AB_018<br>(mRNA with<br>T100 tail) | G*GGGAAAUAAGAGAGAAAAGAAGAGUAAGAAGAAAUAUAAGAGCCACCAUGUGUC<br>ACCAACAGUUAGUAAUCUCCUGGUUUUCUCUGGUGUUUCUGGCCAGCCCCCUCGUG<br>GCCAUCUGGGAGCUUAAAAAGGACGUUUACGUGGUGGAGUUGGAUUGGUAUCCCGA<br>CGCUCCAGGCGAAAUGGUCGUGCUGACCUGCGAUACCCCUGAAGAAGACGGUAUCA<br>CCUGGACGCUGGACCAGUCUUCCGAGGUGCUUGGAUCUGGCAAAACACUGACAAUA<br>CAAGUUAAGGAGUUCGGGACGCAGGGCAGUACACCUGCCACAAAGGCGGCGAGGU<br>CCUGAGUCACUCCCUGUUACUGCUCCACAAGAAAGAGGACGGCAUUUGGUCCACCG<br>ACAUUCUGAAGGACCAGAAGGAGCCUAAGAAUAAACUUUCCGAGAUGCGAGGCA<br>AAAAACUAUAGCGGCCGCUUUACUUGCUGGUGGCUUACAACAAUCUCUACCGAUUU<br>AACUUUCUCCGUGAAGUCUAGCAGAGGAUCCUCUGACCCGCAAGGAGUGACUUGCG<br>GAGCCGCCACCUUGAGCGCCGAAAGAGUCCGUGGCGAUAACAAAGAAUACGAGUAC |

| SEQ ID NO | Description | Sequence |
|---|---|---|
| | | UCCGUGGAGUGCCAGGAAGAUUCCGCCUGCCCAGCUGCCGAGGAGUCCCUGCCCAU UGAAGUGAUGGUGGAUGCCGUCCACAAGCUGAAGUACGAAAACUAUACCAGCAGCU UCUUCAUCCGGGAUAUCAUUAAGCCCGACCCUCCUAAAAACCUGCAACUUAAGCCC CUAAAGAAUAGUCGGCAGGUUGAGGUCAGCUGGGAAUAUCCUGACACAUGGAGCAC CCCCCACUCUUAUUUCUCCCUGACCUUCUGCGUGCAGGUGCAGGGCAAGAGUAAAC GGGAGAAAAAAGAUAGGGUCUUUACCGAUAAAACCAGCGCUACGGUUAUCUGUCGG AAGAACGCUUCCAUCUCCGUCCGCGCUCAGGAUCGUUACUACUCGUCCUCAUGGAG CGAGUGGGCCAGCGUGCCCUGCAGCGGCGGCGGUGGAGGCGGAUCCAGAAAUCUGC CUGUUGCCACACCAGACCCUGGCAUGUUCCCCUGUCUGCAUCAUAGCCAGAACCUG CUCAGAGCCGUGAGCAACAUGCUCCAGAAGGCCAGGCAAACUUUGGAGUUCUACCC GUGUACAUCUGAGGAAAUCGAUCACGAAGAUAUAACCAAAGAUAAAACCUCUACAG UAGAGGCUUGUUUGCCCCUGGAGUUGACCAAAAACGAGAGUUGCCUGAACAGUCGC GAGACGAGCUUCAUUACUAACGGCAGCUGUCUCGCCUCCAGAAAAACAUCCUUCAU GAUGGCCCUGUGUCUUUCCAGCAUAUACGAAGACCUGAAAAUGUACCAGGUCGAGU UCAAAACAAUGAACGCCAAGCUGCUUAUGGACCCCAAGCGGCAGAUCUUCCUCGAC CAAAACAUGCUCGCUGUGAUCGAUGAGCUGAUGCAGGCUCUCAACUUCAAUUCCGA AACAGUGCCACAGAAGUCCAGUCUGGAAGAACCCGACUUCUACAAGACCAAGAUUA AGCUGUGUAUUUUGCUGCAUGCGUUUAGAAUCAGAGCCGUGACCAUUGAUCGGGUG AUGAGCUACCUGAACGCCUCGUGAUAAUAGGCUGGAGCCUCGGUGGCCAUGCUUCU UGCCCCUUGGGCCUCCCCCCAGCCCCUCCUCCCCUUCCUGCACCCGUACCCCCCAA ACACCAUUGUCACACUCCAGUGGUCUUUGAAUAAAGUCUGAGUGGGCGGCAAAAAA AAAAAAAAAAAAAAAAAAAAAAAAAAAAAAAAAAAAAAAAAAAAAAAAAAAAAAAA AAAAAAAAAAAAAAAAAAAAAAAAAAAAAAAAAAAAAAAAAUCUAG G* = a 5' terminal guanosine cap |
| 159 | hIL12AB_019 (mRNA with T100 tail) | G*GGGAAAUAAGAGAAAAGAAGAGUAAGAAGAAAUAUAAGAGCCACCAUGUGCC ACCAGCAGCUUGUCAUCUCCUGGUUUUUCUCUUGUCUUCCUGGCCUCGCCGCUGGUG GCCAUCUGGGAGCUGAAGAAGGACGUUUACGUAGUAGAGUUGGAUUGGUACCCAGA CGCACCUGGAGAAAUGGUGGUUCUCACCUGUGACACUCCUGAAGAAGACGGUAUCA CCUGGACGCUGGACCAAAGCUCAGAAGUUCUUGGCAGUGGAAAAACGCUGACCAUA CAAGUAAAAGAAUUUGGGGAUGCUGGCCAGUACACGUGCCACAAAGGAGGAGAAGU UCUCAGCCACAGUUUACUUCUUCUUCCAAGAAAGAAGAUGGCAUCUGGUCCACAG AUAUUUUAAAAGACCAGAAGGAGCCCAAGAACAAAACCUUCCUCCGCUGUGAGGCC AAGAACUACAGUGGUCGUUUCACCUGCUGGUGGCUCACCACCAUCUCCACUGACCU CACCUUCUCUGUAAAAAGCAGCCGUGGUUCUUCUGACCCCCAAGGAGUCACCUGUG GGGCUGCCACGCUCUCGGCAGAAAGAGUUCGAGGUGACAACAAGGAAUAUGAAUAU UCUGUGGAAUGUCAAGAAGAUUCUGCCUGCCCGGCGGCGAGAAGAAAGUCUUCCCAU AGAAGUCAUGGUGGAUGCUGUUCACAAAUUAAAAUAUGAAAACUACACCAGCAGCU UCUUCAUUCGUGACAUCAUCAAACCAGACCCGCCCAAGAACCUUCAGUUAAAACCU UUAAAAAACAGCCGGCAGGUAGAAGUUUCCUGGGAGUACCCAGAUACGUGGUCCAC GCCGCACUCCUACUUCAGUUUAACCUUCUGUGUACAAGUACAAGGAAAAAUCAAAA GAGAGAAGAAAGAUCGUGUCUUCACUGACAAAACAUCUGCCACGGUCAUCUGCAGG AAGAAUGCCUCCAUCUCGGUUCGAGCCCAGGACCGCUACUACAGCAGCAGCUGGAG UGAGUGGGCAUCUGUUCCCUGCAGUGGUGGCGGCGGCGGCAGCCGCAACCUUC CUGUGGCCACGCCGGACCCUGGCAUGUUCCCUGUGCCUUCACCACUCCCAAAAUCUU CUUCGUGCUGUUUCUAACAUGCUGCAGAAGGCGCGCCAAACUUUAGAAUUCUACCC GUGCACUUCUGAAGAAAUAGACCAUGAAGAUAUCACCAAAGAUAAAACCAGCACGG UGGAGGCCUGCCUUCCUUUAGAGCUGACCAAGAAUGAAUCCUGCCUCAACAGCAGA GAGACCAGCUUCAUCACCAAUGGCAGCUGCCUGGCCUCGCGCAAGACCAGCUUCAU GAUGGCGCUGUGCCUUUCUUCCAUCUAUGAAGAUUUAAAGAUGUACCAAGUAGAAU UUAAAACCAUGAAUGCCAAAUUAUUAAUGGACCCCAAACGGCAGAUAUUUUUGGAU CAAAACAUGCUGGCUGUCAUUGAUGAGCUCAUGCAAGCAUUAAACUUCAACUCAGA AACUGUUCCCCAGAAGUCAUCUUUAGAAGAGCCAGAUUUCUACAAAACAAAAAUAA AACUCUGCAUUCUUCUUCAUGCCUUCCGCAUCCGUGCUGUCACCAUUGACCGUGUC AUGUCCUACUUAAAUGCUUCUUGAUAAUAGGCUGGAGCCUCGGUGGCCAUGCUUCU UGCCCCUUGGGCCUCCCCCCAGCCCCUCCUCCCCUUCCUGCACCCGUACCCCCCAA ACACCAUUGUCACACUCCAGUGGUCUUUGAAUAAAGUCUGAGUGGGCGGCAAAAAA AAAAAAAAAAAAAAAAAAAAAAAAAAAAAAAAAAAAAAAAAAAAAAAAAAAAAAAA AAAAAAAAAAAAAAAAAAAAAAAAAAAAAAAAAAAAAAAAAUCUAG G* = a 5' terminal guanosine cap |
| 160 | hIL12AB_020 (mRNA with T100 tail) | G*GGGAAAUAAGAGAAAAGAAGAGUAAGAAGAAAUAUAAGAGCCACCAUGUGCC ACCAGCAGCUGGUGAUCAGCUGGUUCAGCCUGGUGUUCCUGGCUAGCCCCUCUGGUG GCCAUCUGGGAGCUGAAGAAGGACGUGUACGUGGUGGAGUUGGAUUGGUACCCCGA CGCUCCCGGCGAGAUGGUGGUGCUGACCUGCGACACCCCCGAGGAGGACGGGAUCA CCUGGACCCUGGAUCAGUCAAGCGAGGUGCUGGGAAGCGGCAAGACCCUGACCAUC CAGGUGAAGGAGUUCGGCGACGCCGGCCAAUACACUUGCCACAAGGGAGGCGAGGU GCUGUCCCACUCCCUCCUGCUGCUGCACAAAAAGGAAGACGGCAUCUGGAGCACCG ACAUCCUGAAAGACCAGAAGGAGCCUAAGAACAAAACAUUCCUCAGAUGCGAGGCC AAGAAUUACUCCGGGAGAUUCACCUGUUGGUGGCUGACCACCAUCAGCACAGACCU GACCUUCAGCGUGAAGAGCAGCAGAGGCAGCAGCGACCCCCAGGGCGUGACCUGUG GCGCCGCCACCCUGAGCGCCGAAAGAGUGCGGGCGACAACAAGGAUACGAGUAC UCCGUGGAAUGCCAGGAAGAUAGCGCCUGCCCCGCCGCCGAGGAGAGCCUGCCCAU |

| SEQ ID NO | Description | Sequence |
|---|---|---|
|  |  | CGAGGUGAUGGUGGACGCCGUCCACAAGCUGAAGUACGAGAACUACACCUCUAGCU UCUUCAUCAGAGAUAUCAUCAAGCCCGAUCCCCCCAAGAACCUGCAGCUGAAACCC CUGAAGAACAGCCGGCAGGUGGAGGUGAGCUGGGAGUAUCCCGACACCUGGUCCAC CCCCCACAGCUAUUUUAGCCUGACCUUCUGCGUGCAAGUGCAGGGCAAGAGCAAGA GAGAGAAGAAGGACCGCGUGUUCACCGACAAAACCAGCGCCACCGUGAUCUGCAGA AAGAACGCCAGCAUCAGCGUGAGGGCCCAGGAUAGAUACUACAGUUCCAGCUGGAG CGAGUGGGCCAGCGUGCCCUGCAGCGGCGGCGGCGGGGGAGGCUCGAGAAACCUGC CGUGGCUACCCCCGAUCCCGGAAUGUUCCCCUGCCUGCACCACAGCCAGAACCUG CUGAGGGCGGUGUCCAACAUGCUUCAGAAGGCCCGGCAGACCCUGGAGUUCUACCC CUGUACCUCUGAGGAGAUCGAUCAUGAAGAUAUCACAAAAGAUAAAACCAGCACCG UGGAGGCCUGCCUGCCCCUGGAGCUGACCAAGAACGAGAGCUGCCUGAACUCCCGC GAGACCAGCUUCAUCACGAACGGCAGCUGCCUGGCCAGCAGGAAGACCUCCUUCAU GAUGGCCCUGUGCCUGAGCAGCAUCUACGAGGACCUGAAAAUGUACCAGGUGGAGU UUAAGACCAUGAACGCCAAGCUGCUGAUGGACCCCAAGCGGCAAAUCUUCCUGGAC CAGAACAUGCUGGCAGUGAUCGACGAGCUCAUGCAGGCCCUGAACUUCAAUAGCGA GACGGUCCCCCAGAAGAGCAGCCUGGAGGAGCCCGACUUUUACAAGACCAAGAUCA AGCUGUGCAUCCUGCUGCACGCCUUUAGAAUCCGUGCCGUGACCAUUGACAGAGUG AUGAGCUACCUGAAUGCCAGCUGAUAAUAGGCUGGAGCCUCGGUGGCCAUGCUUCU UGCCCCUUGGGCCUCCCCCCAGCCCCUCCUCCCCUUCCUGCACCCGUACCCCCCAA ACACCAUUGUCACACUCCAGUGGUCUUUGAAUAAAGUCUGAGUGGGCGGCAAAAAA AAAAAAAAAAAAAAAAAAAAAAAAAAAAAAAAAAAAAAAAAAAAAAAAAAAAAAAA AAAAAAAAAAAAAAAAAAAAAAAAAAAAAAAAAAAAUCUAG G* = a 5' terminal guanosine cap |
| 161 | hIL12AB_021 (mRNA with T100 tail) | G*GGGAAAUAAGAGAGAAAAGAAGAGUAAGAAGAAAUAUAAGAGCCACCAUGUGCC ACCAGCAGCUGGUGAUCAGCUGGUUCAGCCUGGUGUUCCUGGCCAGCCCUCUGGUU GCCAUCUGGGAGCUGAAGAAAGACGUGUACGUCGUGGAACUGGACUGGUAUCCGGA CGCCCCGGGCGAGAUGGUGGUGCUGACCUGUGACACCCCCGAGGAGGACGGCAUCA CCUGGACGCUGGACCAAUCCUCCGAGGUGCUGGGAAGCGGCAAGACCCUGACCAUC CAGGUGAAGGAAUUCGGGGACGCCGGGCAGUACACCUGCCACAAGGGGGGCGAAGU GCUGUCCCACUCGCUGCUGCUCCUGCAUAAGAAGGAGGAUGGAAUCUGGUCCACCG ACAUCCUCAAAGAUCAGAAGGAGCCCAAGAACAAGACGUUCCUGCGCUGUGAAGCC AAGAAUUAUUCGGGGCGAUUCACGUGCUGGUGGCUGACAACCAUCAGCACCGACCU GACGUUUAGCGUGAAGAGCAGCAGGGGGUCCAGCGACCCCCAGGGCGUGACGUGCG GCGCCGCCACCCUCUCCGCCGAGAGGGUGCGGGGGGACAAUAAGGAGUACGAGUAC AGCGUGGAAUGCCAGGAGGACAGCGCCUGCCCCGCCGCGGAGGAAAGCCUCCCGAU AGAGGUGAUGGUGGACGCCGUGCACAAGCUCAAGUAUGAGAAUUACACCAGCAGCU UUUUCAUCCGGGACAUUAUCAAGCCCGACCCCCCGAAGAACCUCCAGCUGAAGCCC CUGAAGAACAGCCGGCAGGUGGAAGUCUCCUGGGAGUAUCCCGACACCUGGAGCAC CCCGCACAGCUACUUCUCCCUGACCUUCUGUGUGCAGGUGCAGGGCAAGUCCAAGA GGGAAAAGAAGGACAGGGUUUUCACCGACAAGACCAGCGCGACCGUGACUGCCGG AAGAACGCCAGCAUAAGCGUCCGCGCCCAAGAUAGGUACUACAGCAGCUCCUGGAG CGAGUGGGCUAGCGUGCCCUGCAGCGGGGGCGGGGUGGGGGCUCCAGGAACCUGC CAGUGGCGACCCCCGACCCCGGCAUGUUCCCCUGCCUCCAUCACAGCCAGAACCUG CUGAGGGCCGUCAGCAAUAUGCUGCAGAAGGCCAGGCAGACCCUGGAAUUCUACCC CUGCACGUCGGAGGAGAUCGAUCACGAGGAUAUCACAAAAGACAAGACUUCCACCG UGGAGGCCUGCCUGCCCCUGGAGCUCACCAAGAAUGAGUCCUGUCUGAACUCCCGG GAAACCAGCUUCAUCACCAACGGGUCCUGCCUGGCCAGCAGGAAGACCAGCUUUAU GAUGGCCCUGUGCCUGUCGAGCAUCUACGAGGACCUGAAGAUGUACCAGGUCGAGU UCAAGACAAUGAACGCCAAGCUGCUGAUGGACCCCAAGAGGCAAAUCUUCCUGGAC CAGAAUAUGCUUGCCGUCAUCGACGAGCUCAUGCAGGCCCUGAACUUCAACUCCGA GACCGUGCCCCAGAAGAGCAGCCUGGAGGAGCCCGACUUCUACAAGACCAAGAUCA AGCUGUGCAUCCUGCUGCACGCGUUCAGGAUCCGGGCAGUCACCAUCGACCGUGUG AUGUCCUACCUGAACGCCAGCUGAUAAUAGGCUGGAGCCUCGGUGGCCAUGCUUCU UGCCCCUUGGGCCUCCCCCCAGCCCCUCCUCCCCUUCCUGCACCCGUACCCCCCAA ACACCAUUGUCACACUCCAGUGGUCUUUGAAUAAAGUCUGAGUGGGCGGCAAAAAA AAAAAAAAAAAAAAAAAAAAAAAAAAAAAAAAAAAAAAAAAAAAAAAAAAAAAAAA AAAAAAAAAAAAAAAAAAAAAAAAAAAAAAAAAAAAUCUAG G* = a 5' terminal guanosine cap |
| 162 | hIL12AB_022 (mRNA with T100 tail) | G*GGGAAAUAAGAGAGAAAAGAAGAGUAAGAAGAAAUAUAAGAGCCACCAUGUGCC AUCAGCAGCUGGUGAUCAGCUGGUUCAGCCUGGUGUUCCUCGCCUCUCCCCUGGUG GCCAUCUGGGAGCUCAAAAAGGACGUGUACGUGGUGGAGCUCGACUGGUACCCAGA CGCCCCGGGGAGAUGGUGGUGCUGACCUGCGACACCCCCGAAGAAGACGGCAUCA CGUGGACCCUCGACCAGUCCAGCGAGGUGCUGGGGAGCGGGAAGACUCUGACCAUC CAGGUCAAGGAGUUCGGGGACGCCGGGCAGUACACGUGCCACAAGGGCGGCGAAGU CUUUAAGCCACAGCCUGCUCCUGCUGCACAAGAAGGAGGACGGGAUCUGGUCCACAG ACAUACUGAAGGACCAGAAGGAGCCGAAGAAUAAAACCUUUCUGAGGUGCGAGGCC AAGAACUAUUCCGGCAGGUUCACGUGCUGGUGGCUUACAACAAUCAGCACAGACCU GACGUUCAGCGUGAAGUCCAGCCGCGGCAGCAGCGACCCCCAGGGGGUGACCUGCG GCGCCGCCACCCUGAGCGCCGAGCGGGUGCGCGGGGACAACAAGGAGUACGAGUAC UCCGUGGAGUGCCAGGAAGACAGCGCCUGUCCCGCCGCCGAAGAGAGCCUGCCUAU CGAGGUCAUGGUAGAUGCAGUGCAUAAGCUGAAGUACGAGAACUAUACGAGCAGCU |

SUMMARY OF SEQUENCES

| SEQ ID NO | Description | Sequence |
|---|---|---|
| | | UUUUCAUACGCGACAUCAUCAAGCCCGACCCCCCCAAGAACCUGCAGCUUAAGCCC CUGAAGAAUAGCCGGCAGGUGGAGGUCUCCUGGGAGUACCCCGACACCUGGUCAAC GCCCCACAGCUACUUCUCCCUGACCUUUUGUGUCCAAGUCCAGGGAAAGAGCAAGA GGGAGAAGAAAGAUCGGGUGUUCACCGACAAGACCUCCGCCACGGUGAUCUGCAGG AAGAACGCCAGCAUCUCCGUGAGGGCGCAAGACAGGUACUACUCCAGCAGCUGGUC CGAAUGGGCCAGCGUGCCCUGCUCCGGCGGCGGGGGCGGCGGCAGCCGAAACCUAC CCGUGGCCACGCCGGAUCCCGGCAUGUUUCCCUGCCUGCACCACAGCCAGAACCUC CUGAGGGCCGUGUCCAACAUGCUGCAGAAGGCCAGGCAGACUCUGGAGUUCUACCC CUGCACGAGCGAGGAGAUCGAUCACGAGGACAUCACCAAGGAUAAGACCAGCACUG UGGAGGCCUGCCUUCCCCUGGAGCUGACCAAGAACGAGAGCUGUCUGAACUCCAGG GAGACCUCAUUCAUCACCAACGGCUCCUGCCUGGCCAGCAGGAAAACCAGCUUCAU GAUGGCCUUGUGUCUCAGCUCCAUCUACGAGGACCUGAAGAUGUAUCAGGUCGAGU UCAAGACCAUGAACGCCAAGCUGCUGAUGGACCCCAAAAGGCAGAUCUUCCUGGAC CAGAACAUGCUGGCCGUCAUCGACGAGCUGAUGCAGGCCCUGAACUUCAACAGCGA GACGGUGCCCCAGAAAAGCUCCCUGGAGGAGCCCGACUUCUACAAGACCAAGAUCA AGCUGUGCAUCCUGCUGCACGCCUUCAGGAUCAGGGCAGUGACCAUCGACCGGGUG AUGUCAUACCUUAACGCCAGCUGAUAAUAGGCUGGAGCCUCGGUGGCCAUGCUUCU UGCCCCUUGGGCCUCCCCCCAGCCCCUCCUCCCCUUCCUGCACCCGUACCCCCCAA ACACCAUUGUCACACUCCAGUGGUCUUUGAAUAAAGUCUGAGUGGGCGGCAAAAAA AAAAAAAAAAAAAAAAAAAAAAAAAAAAAAAAAAAAAAAAAAAAAAAAAAAAAAAAA AAAAAAAAAAAAAAAAAAAAAAAAAAAAAAAAAAAAAAAUCUAG G* = a 5' terminal guanosine cap |
| 163 | hIL12AB_023 (mRNA with T100 tail) | G*GGGAAAUAAGAGAGAAAAGAAGAGUAAGAAGAAAUAUAAGAGCCACCAUGUGCC AUCAGCAGCUGGUGAUCUCCUGGUUCAGCCUGGUGUUUCUGGCCUCGCCCCUGGUC GCCAUCUGGGAGCUGAAGAAAGACGUGUACGUCGUGGAACUGGACUGGUACCCCGA CGCCCCCGGGGAGAUGGUGGUGCUGACCUGCGACACGCCGGAGGAGGACGGCAUCA CCUGGACCCUGGAUCAAAGCAGCGAGGUGCUGGGCAGUACACCUGUCACAAAGGGGGCGAGGU GCUCAGCCACAGCCUGCUGCUGCUGCACAAGAAGGAGGAUGGCAUCUGGAGCACCG AUAUCCUGAAGGACCAGAAAGAGCCCAAGAACAAGACGUUCCUGAGGUGCGAGGCC AAGAACUACAGCGGUAGGUUCACGUGUUGGUGGCUGACCACCAUCAGCACCGACCU GACGUUCAGCGUGAAGAGCUCCAGGGGCAGCUCCGACCCACAGGGGGUGACGUGCG GGGCCGCAACCCUCAGCGCCGAAAGGGUGCGGGGGGACAACAAGGAGUACGAAUAC UCCGUGGAGUGCCAGGAAGAUUCGGCCUGCCCCGCCGCGGAGGAGAGCCUCCCCAU CGAGGUAAUGGUGGACGCCGUGCAUAAGCUGAAGUACGAGAACUACACCAGCUCGU UCUUCAUCCGAGACAUCAUCAAACCCGACCCGCCCAAAAAUCUGCAGCUCAAGCCC CUGAAGAACUCCAGGCAGGUGGAGGUGAGCUGGGAGUACCCCGACACCUGGUCCAC CCCGCACAGCUACUUCUCCCUGACAUUCUGCGUGCAGGUGCAGGGCAAGAGCAAGC GGGAGAAGAAGGACAGGGUGUUCACCGACAAGACGAGCGCCACCGUGAUCUGCCGA AAGAACGCCAGCAUCUCGGUGCGCGCCCAGGAUAGGUACUAUUCCAGCUCCUGGAG CGAGUGGGCCUCGGUACCCUGCAGCGGCGGCGGGGGCGGCGGCAGUAGGAAUCUGC CCGUGGCUACCCCGGACCCGGGCAUGUUCCCCUGCCUCCACCAGCCAGAACCUG CUGAGGGCCGUGAGCAACAUGCUGCAGAAGGCCAGACAGACGCUGGAGUUCUACCC CUGCACGAGCGAGGAGAUCGACCACGAGGACAUCACCAAGGAUAAAAACUUCCACCG UCGAGGCCUGCCUGCCCUUGGAGCUGACCAAGAAUGAAUCCUGUCUGAACAGCAGG GAGACCUCGUUUAUCACCAAUGGCAGCUGCCUCGCCUCCAGGAAGACCAGCUUCAU GAUGGCCCUCUGUCUGAGCUCCAUCUAUGAGGACCUGAAGAUGUACCAGGUGGAGU UCAAGACCAUGAACGCCAAGCUGCUGAUGGACCCCAAGAGGCAGAUCUUCCUGGAU CAGAAUAUGCUGGCGGUGAUCGACGAGCUCAUGCAGGCCCUCAAUUUCAAUAGCGA GACAGUGCCCCAGAAGUCCUCCCUGGAGGAGCCCGACUUCUACAAGACCAAGAUCA AGCUGUGUAUCCUGCUGCACGCCUUCCGGAUCCGGGCCGUCACCAUCGACCGGGUC AUGAGCUACCUCAAUGCCAGCUGAUAAUAGGCUGGAGCCUCGGUGGCCAUGCUUCU UGCCCCUUGGGCCUCCCCCCAGCCCCUCCUCCCCUUCCUGCACCCGUACCCCCCAA ACACCAUUGUCACACUCCAGUGGUCUUUGAAUAAAGUCUGAGUGGGCGGCAAAAAA AAAAAAAAAAAAAAAAAAAAAAAAAAAAAAAAAAAAAAAAAAAAAAAAAAAAAAAAA AAAAAAAAAAAAAAAAAAAAAAAAAAAAAAAAAAAAAAAUCUAG G* = a 5' terminal guanosine cap |
| 164 | hIL12AB_024 (mRNA with T100 tail) | G*GGGAAAUAAGAGAGAAAAGAAGAGUAAGAAGAAAUAUAAGAGCCACCAUGUGCC ACCAGCAGCUGGUGAUCUCCUGGUUCUCCCUGGUGUUCCUGGCCUCGCCCCUGGUG GCCAUCUGGGAGCUGAAGAAGGACGUGUACGUCGUGGAGCUCGACUGGUACCCCGA CGCCCCUGGCGAGAUGGUGGUGCUGACCUGCGACACCCCAGAGGAGGAUGGCAUCA CCUGGACCCUGGAUCAGUCCUCCGAGGUGCUGGGCUCCGGCAAGACGCUGACCAUC CAAGUGAAGGAGUUCGGUGACGCCGGACAGUAUACCUGCCAUAAGGGCGGCGAGGU CCUGUCCCACAGCCUCCUCCUCCUGCAUAAGAAGGAGGACGGCAUCUGGAGCACCG ACAUCCUGAAGGACCAGAAAGAGCCCAAGAACAAGACCUUUCUGAGGUGCGAGGCC AAGAACUACAGCGGCCGAUUCACCUGCUGGUGGCUCACCACCAUAUCCACCGACCU GACUUUCUCCGUCAAGUCCUCCCGGGGGUCCAGCGACCCCCAGGGAGUGACCUGCG GCGCCGCACCCCUCAGCGCCGAGCGGGUGCGGGGGGACAACAAGGAGUACGAAUAC UCCGUCGAGUGCCAGGAGGACUCCGCCUGCCCGGCCGCCGAGGAGAGCCUGCCCAU CGAGGUGAUGGUCGACGCGGUGCACAAGCUGAAGUACGAGAACUACACCAGCAGUU UCUUCAUCAGGGAUAUCAUCAAGCCAGAUCCCCCGAAGAAUCUGCAACUGAAGCCG |

| SUMMARY OF SEQUENCES | | |
|---|---|---|
| SEQ ID NO | Description | Sequence |
| | | CUGAAAAACUCACGACAGGUGGAGGUGAGCUGGGAGUACCCCGACACGUGGAGCAC CCCACAUUCCUACUUCAGCCUGACCUUCUGCGUGCAGGUCCAGGGCAAGAGCAAGC GGGAGAAGAAGGACAGGGUGUUCACGGAUAAGACCAGUGCCACCGUGAUCUGCAGG AAGAACGCCUCUAUUAGCGUGAGGGCCCAGGAUCGGUAUUACUCCUCGAGCUGGAG CGAAUGGGCUCCCGUGCCCUGCAGUGGGGGGGUGGAGGCGGGAGCAGGAACCUGC CCGUAGCAACCCCCGACCCCGGGAUGUUCCCCUGUCUGCACCACUCGCAGAACCUG CUGCGCGCGGUGAGCAACAUGCUCCAAAAAGCCCGUCAGACCUUAGAGUUCUACCC CUGCACCAGCGAAGAAAUCGACCACGAAGACAUCACCAAGGACAAAACCAGCACCG UGGAGGCGUGCCUGCCGCUGGAGCUGACCAAGAACGAGAGCUGCCUCAACUCCAGG GAGACCAGCUUUAUCACCAACGGCUCGUGCCUAGCCAGCCGGAAAACCAGCUUCAU GAUGGCCCUGUGCCUGAGCUCCAUUUACGAGGACCUGAAGAUGUAUCAGGUGGAGU UCAAGACCAUGAAUGCCAAACUCCUGAUGGACCCCAAGAGGCAGAUCUUCCUGGAC CAGAACAUGCUCCGGUGAUCGAUGAGCUGAUGCAGGCCCUGAACUUUAUAGCGA GACCGUGCCCCAGAAAAGCAGCCUGGAGGAGCCGGACUUCUACAAGACCAAAAUCA AGCUGUGCAUCCUGCUCCACGCCUUCCGCAUCCGGGCCGUGACCAUCGACAGGGUG AUGAGCUACCUGAACGCCAGCUGAUAAUAGGCUGGAGCCUCGGUGGCCAUGCUUCU UGCCCCUUGGGCCUCCCCCCAGCCCCUCCUCCCCUUCCUGCACCCGUACCCCCCAA ACACCAUUGUCACACUCCAGUGGUCUUUGAAUAAAGUCUGAGUGGGCGGCAAAAAA AAAAAAAAAAAAAAAAAAAAAAAAAAAAAAAAAAAAAAAAAAAAAAAAAA AAAAAAAAAAAAAAAAAAAAAAAAAAAAAAAAAAAAAAAAAUCUAG G* = a 5' terminal guanosine cap |
| 165 | hIL12AB_025 (mRNA with T100 tail) | G*GGGAAAUAAGAGAGAAAAGAAGAGUAAGAAGAAAUAUAAGAGCCACCAUGUGCC AUCAGCAGCUGGUGAUUUCCUGGUUCUCCCUGGUGUUCCUGGGCCAGCCCCCUCGUG GCGAUCUGGGAGCUAAAGAAGGACGUGUACGUGGUGGAGCUGGACUGGUACCCGGA CGCACCCGGCGAGAUGGUCGUUCUGACCUGCGAUACGCCAGAGGAGGACGGCAUCA CCUGGACCCUCGAUCAGAGCAGCGAGGUCCUGGGGAGCGGAAAGACCCUGACCAUC CAGGUCAAGGAGUUCGGCGACGCCGGCCAGUACACCUGCCACAAAGGUGGCGAGGU CCUGAGCCACUCGCUGCUGCUCCUGCAUAAGAAGGAGGACGGAAUCUGGAGCACAG ACAUCCUGAAAGACCAGAAGGAGCCCAAGAACAAGACCUUCCUGAGGUGCGAGGCC AAGAACUACAGCGGGCGCUUCACGUGCUGGUGGCUGACCACCAUCAGCACGGACCU CACCUUCUCCGUGAAGAGCAGCCGGGGAUCCAGCGAUCCCCAAGGCGUCACCUGCG GCGCGGCCACCCUGAGCGCGGAGAGGGUCAGGGGCGAUAAUAAGGAGUAUGAGUAC AGCGUGGAGUGCCAGGAGGACAGCGCCUGCCCGGCCGCCGAGGAGUCCCUGCCAAU CGAAGUGAUGGUCGACGCCGUGCACAAGCUGAAGUACGAGAACUACACCAGCAGCU UCUUCAUCCGGGAUAUCAUCAAGCCCGAUCCCCGAAGAACCUGCAGCUGAAGCCC CUCAAGAACAGCCGGCAGGUGGAGGUGAGUUGGGAGUACCCCGACACCUGGUCAAC GCCCCACAGCUACUUCUCCCUGACCUUCUGUGUGCAGGUGCAGGGAAAGAGCAAGA GGGAGAAGAAAGACCGGGUCUUCACCGACAAGACCAGCGCCACGGUGAUCUGCAGG AAGAACGCAAGCAUCUCCGUGAGGGCCCAGGACAGGUACUACAGCUCCAGCUGGUC CGAAUGGGCCAGCGUGCCCUGUAGCGGCGGCGGGGGCGGUGGCAGCCGCAACCUCC CAGUGGCCACCCCCGACCCCGGCAUGUUCCCCUGCCUGCACCACAGCCAGAAUCUG CUGAGGGCCGUGAGUAACAUGCUGCAGAAGGCAAGGCAAACCCUCGAAUUCUAUCC CUGCACCUCCGAGGAGAUCGACCACGAGGAUAUCACCAAGGACAAGACCAGCACCG UCGAGGCCUGUCUCCCCCUGGAGCUGACCAAGAAUGAGAGCUGCCUGAACAGCCGG GAGACCAGCUUCAUCACCAACGGGAGCUGCCUGGCCUCCAGGAAGACCUCGUUCAU GAUGGCGCUGUGCCUCUCAAGCAUAUACGAGGAUCUGAAGAUGUACCAGGUGGAGU UUAAGACGAUGAACGCCAAGCUGCUGAUGGACCCGAAGAGGCAGAUCUUCCUGGAC CAGAACAUGCUGGCCGUGAUAGACGAGCUCAUGCAGGCCCUGAACUUCAACUCCGA GACCGUGCCGCAGAAGUCAUCCCUCGAGGAGCCCGACUUCUAUAAGACCAAGAUCA AGCUGUGCAUCCUGCUCCACGCCUUCCGGAUAAGGGCCGUGACGAUCGACAGGGUG AUGAGCUACCUUAACGCCAGCUGAUAAUAGGCUGGAGCCUCGGUGGCCAUGCUUCU UGCCCCUUGGGCCUCCCCCCAGCCCCUCCUCCCCUUCCUGCACCCGUACCCCCCAA ACACCAUUGUCACACUCCAGUGGUCUUUGAAUAAAGUCUGAGUGGGCGGCAAAAAA AAAAAAAAAAAAAAAAAAAAAAAAAAAAAAAAAAAAAAAAAAAAAAAAAA AAAAAAAAAAAAAAAAAAAAAAAAAAAAAAAAAAAAAAUCUAG G* = a 5' terminal guanosine cap |
| 166 | hIL12AB_026 (mRNA with T100 tail) | G*GGGAAAUAAGAGAGAAAAGAAGAGUAAGAAGAAAUAUAAGAGCCACCAUGUGCC ACCAGCAGCUCGUGAUCAGCUGGUUCUCCCUGGUGUUUCUCGCCAGCCCCCUGGUG GCCAUCUGGGAGCUGAAGAAGGACGUGUACGUGGUGGAGCUGGACUGGUACCCUGA CGCCCCGGGGGAGAUGGUCGUGCUGACCUGCGACACCCCCGAAGAGGACGGUAUCA CCUGGACCCUGGACCAGUCCAGCGAGGUGCUGGGCAGCGGCAAGACCCUGACUAUU CAAGUCAAGGAGUUCGGAGACGCCGGCCAGUACACCUGCCACAAGGGUGGAGAGGU GUUAUCACACAGCCUGCUGCUGCUGCACAAGAAGGAAGACGGGAUCUGGAGCACCG ACAUCCUGAAGGACCAGAAGGAGCCCAAAAACAAGACCUUCCUGCGGUGCGAGGCC AAGAACUAUUCGGCCGCUUUACGUGCUGGUGGCUGACCACCAUCAGCACUGAUCU CACCUUCAGCGUGAAGUCCUCCCGGGGGUCGUCCGACCCCCAGGGGGUGACCUGCG GGGCCGCCACCCUGUCCGCCGAGAGAGUGAGGGGCGAUAAUAAGGAGUACGAGUAC AGCGUUGAGUGCCAGGAAGAUAGCGCCUGUCCCGCCGCCGAGGAGAGCCUGCCCAU CGAGGUGAUGGUGGACGCCGUCCACAAGCUGAAGUAUGAGAACUACACCUCAAGCU UCUUCAUCAGGGACAUCAUCAAACCCGAUCCGCCCAAGAAUCUGCAGCUGAAGCCC CUGAAAAUAGCAGGCAGGUGGAGGUGAGCUGGGAGUACCCCGACACCUGGUCCAC |

| SEQ ID NO | Description | Sequence |
|---|---|---|
|  |  | CCCCCAUAGCUAUUUCUCCCUGACGUUCUGCGUGCAGGUGCAAGGGAAGAGCAAGC GGGAGAAGAAGGACCGGGUGUUCACCGACAAGACCUCCGCCACCGUGAUCUGUAGG AAGAACGCGUCGAUCUCGGUCAGGGCCCAGGACAGGUAUUACAGCAGCAGCUGGAG CGAGUGGGCGAGCGUGCCCUGCUCGGGCGGCGGCGGCGGCGGGAGCAGAAAUCUGC CCGUGGCCACCCCAGACCCCGGAAUGUUCCCCUGCCUGCACCAUUCGCAGAACCUC CUGAGGGCCGUGAGCAACAUGCUGCAGAAGGCCCGCCAGACGCUGGAGUUCUACCC CUGCACGAGCGAGGAGAUCGACCACGAAGACAUCACCAAGGACAAAACCAGCACCG UGGAGGCCUGCCUGCCCCUGGAGCUGACCAAAAACGAAUCCUGCCUCAACAGCCGG GAGACCAGCUUCAUCACCAACGGCAGCUGCCUGGCCAGCCGAAAGACCUCCUUCAU GAUGGCCCUCUGCCUGAGCAGCAUCUAUGAGGAUCUGAAGAUGUAUCAGGUGGAGU UCAAGACCAUGAAUGCCAAGCUGCUGAUGGACCCCAAGAGGCAGAUAUUCCUGGAC CAGAAUAUGCUGGCCGUGAUCGACGAGCUGAUGCAGGCCCUGAACUUCAACAGCGA GACCGUCCCCCAGAAGUCCAGCCUGGAGGAGCCGGACUUUUACAAAACGAAGAUCA AGCUGUGCAUACUGCUGCACGCCUUCAGGAUCCGGGCCGUGACAAUCGACAGGGUG AUGUCCUACCUGAACGCCAGCUGAUAAUAGGCUGGAGCCUCGGUGGCCAUGCUUCU UGCCCCUUGGGCCUCCCCCCAGCCCUCCUCCCCUUCCUGCACCCGUACCCCCCAA ACACCAUUGUCACACUCCAGUGGUCUUUGAAUAAAGUCUGAGUGGGCGGCAAAAAA AAAAAAAAAAAAAAAAAAAAAAAAAAAAAAAAAAAAAAAAAAAAAAAAAAAAAAA AAAAAAAAAAAAAAAAAAAAAAAAAAAAAAAAAAAAAAAUCUAG G* = a 5' terminal guanosine cap |
| 167 | hIL12AB_027 (mRNA with T100 tail) | G*GGGAAAUAAGAGAGAAAAGAAGAGUAAGAAGAAAUAUAAGAGCCACCAUGUGUC ACCAGCAGCUGGUGAUCAGCUGGUUCUCCCUGGUGUUCCUGGCCAGCCCCCUGGUG GCCAUCUGGGAGCUCAAGAAGGACGUCUACGUCGUGGAGCUGGAUUGGUACCCCGA CGCUCCCGGGGAGAUGGUGGUGCUGACCUGCGACACCCCCGAGGAGGACGGCAUCA CCUGGACGCUGGACCAGAGCUCAGAGGUGCUGGGAAGCGGAAAGACACUGACCAUC CAGGUGAAGGAGUUCGGGGAUGCCGGGCAGUAUACCUGCCACAAGGGCGGCGAAGU GCUGAGCCAUUCCCUGCUGCUGCUGCACAAGAAGGAGGACGGCAUAUGGUCCACCG ACAUCCUGAAGGAUCAGAAGGAGCCGAAGAAUAAAACCUUCCUGAGGUGCGAGGCC AAGAAUUACAGCGGCCGAUUCACCUGCUGGUGGCUGACCACCAUCAGCACCGACCU GACCUUCAGUGUGAAGUCCUCACGGGGCAGCUCAGAUCCCCAGGGCGUGACCUGCG GGGCCGCGACACUCAGCGCCGAGCGGGUGAGGGGUGAUAACAAGGAGUACGAGUAU UCUGUGGAGUGCCAGGAAGACUCCGCCUGUCCCGCCGCCGAGGAGUCCCUGCCCAU CGAGGUGAUGGUGGACGCCGUGCAUAAACUGAAGUACGAGAACUACACCUCCAGCU UCUUCAUCCGGGAUAUAAUCAAGCCCGACCCUCCGAAAAACCUGCAGCUGAAGCCC CUUAAAAACAGCCGGCAGGUGGAGGUGAGCUGGGAGUACCCCGACACCUGGAGCAC CCCCCAUAGCUAUUUCAGCCUGACCUUCUGCGUGCAGGUGCAGGGGAAGUCCAAGC GCGAGAAAAGGACCGGGUGUUCACCGACAAGACGAGCGCCACCGUGAUCUGCCGG AAGAACGCCAGUAUAAGCGUAAGGGCCCAGGAUAGGUACUACAGCUCCAGCUGGUC GGAGUGGGCCUCCGUGCCCUGUUCCGGCGGCGGGGGGGGUGGCAGCAGGAACCUCC CCGUGGCCACGCCGGACCCCGGCAUGUUCCCGUGCCUGCACCACUCCCAAAACCUC CUGCGGGCCGUCAGCAACAUGCUGCAAAAGGCGCGGCAGACCCUGGAGUUUUACCC CUGUACCUCCGAAGAGAUCGACCACGAGGAUAUCACCAAGGAUAAGACCUCCACCG UGGAGGCCUGUCUCCCCCUGGAGCUGACCAAGAACGAGAGCUGUCUUAACAGCAGA GAGACCUCGUUCAUAACGAACGGCUCCUGCCUCGCUUCCAGGAAGACGUCGUUCAU GAUGGCGCUGUGCCUGUCCAGCAUCUACGAGGACCUGAAGAUGUAUCAGGUCGAGU UCAAAACCAUGAACGCCAAGCUGCUGAUGGACCCCAAGAGGCAGAUCUUCCUGGAC CAGAACAUGCUGCCGUGAUCGACGAGCUGAUGCAGGCCCUGAACUUCAACAGCGA AACCGUGCCCCAGAAGUCAAGCCUGGAGGAGCCGGACUUCUAUAAGACCAAGAUCA AGCUGUGUAUCCUGCUACACGCUUUUCGUAUCCGGGCCGUGACCAUCGACAGGGUU AUGUCGUACUUGAACGCCAGCUGAUAAUAGGCUGGAGCCUCGGUGGCCAUGCUUCU UGCCCCUUGGGCCUCCCCCCAGCCCUCCUCCCCUUCCUGCACCCGUACCCCCCAA ACACCAUUGUCACACUCCAGUGGUCUUUGAAUAAAGUCUGAGUGGGCGGCAAAAAA AAAAAAAAAAAAAAAAAAAAAAAAAAAAAAAAAAAAAAAAAAAAAAAAAAAAAAA AAAAAAAAAAAAAAAAAAAAAAAAAAAAAAAAAAAAAAAUCUAG G* = a 5' terminal guanosine cap |
| 168 | hIL12AB_028 (mRNA with T100 tail) | G*GGGAAAUAAGAGAGAAAAGAAGAGUAAGAAGAAAUAUAAGAGCCACCAUGUGCC ACCAACAGCUCGUGAUCAGCUGGUUCAGCUGGUGUUCCUGGCCAGCCCCGCUGGUG GCCAUCUGGGAGCUGAAGAAGGACGUGUACGUGGUGGAGCUGGACUGGUACCCCGA CGCCCCCGGCGAGAUGGUGGUCCUGACCUGCGACACGCCGGAAGAGGACGGCAUCA CCUGGACCCUGGAUCAGUCCAGCGAGGUGCUGGGCUCCGGCAAGACCCUGACCAUU CAGGUGAAGGAGUUCGGCGACGCCGGUCAGUACACCUGCCACAAGGGCGGCGAGGU GCUGAGCCACAGCCUACUGCUCCUGCACAAAAAGGAGGAUGGAAUCUGGUCCACCG ACAUCCUCAAGGACCAGAAGGAGCCGAAGAACAAGACGUUCCUCCGGUGCGAGGCC AAGAACUACAGCGGCAGGUUUACCUGCUGGUGGCUGACCACCAUCAGCACCGACCU GACAUUUCCGUGAAGAGCAGCCGCGGCAGCUCCGAUCCCCAGGGCGUGACCUGCG GGGCGGCCACCCUGUCCGCCGAGCGUGUGAGGGGCGACAACAAGGAGUACGAGUAC AGCGUGGAAUGCCAGGAGGACAGCGCCUGUCCCGCCGCCGAGGAGAGCCUGCCAAU CGAGGUCAUGGUGGACGCCGUGCACAAGCUGAAGUACGAGAACUACACGAGCAGCU UCUUCAUCAGGGACAUCAUCAAACCGGACCCGCCCAAGAACCUGCAGCUGAAACCC UUGAAAAACAGCAGGCAGGUGGAAGUGUCUUGGGAGUACCCCGACACCUGGUCCAC CCCCCACAGCUACUUUAGCCUGACCUUCUGUGUGCAGGUCCAGGGCAAGUCCAAGA |

SUMMARY OF SEQUENCES

| SEQ ID NO | Description | Sequence |
|---|---|---|
| | | GGGAGAAGAAGGACAGGGUGUUCACCGACAAAACCAGCGCCACCGUGAUCUGCAGG AAGAACGCCUCCAUCAGCGUGCGGGCCCAGGACAGGUAUUACAGCUCGUCGUGGAG CGAGUGGGCCAGCGUGCCCUGCUCCGGGGGAGGCGGCGGCGGAAGCCGGAAUCUGC CGUGGCCACCCCCGAUCCCGGCAUGUUCCCGUGUCUGCACCACAGCCAGAACCUG CUGCGGGCCGUGAGCAACAUGCUGCAGAAGGCCCGCCAAACCCUGGAGUUCUACCC CUGUACAAGCGAGGAGAUCGACCAUGAGGACAUUACCAAGGACAAGACCAGCACCG UGGAGGCCUGCCUGCCCCUCGAGCUCACAAAGAACGAAUCCUGCCUGAAUAGCCGC GAGACCAGCUUUAUCACGAACGGGUCCUGCCUCGCCAGCCGGAAGACAAGCUUCAU GAUGGCCCUGUGCCUGAGCAGCAUCUACGAGGACCUGAAAAUGUACCAAGUGGAGU UCAAAACGAUGAACGCCAAGCUGCUGAUGGACCCCAAGCGCCAGAUCUUCCUGGAC CAGAACAUGCUGGCCGUCAUCGACGAGCUCAUGCAGGCCCUGAACUUCAACAGCGA GACCGUGCCCCAGAAGAGCAGCCUGGAGGAGCCCGACUUCUACAAGACGAAGAUCA AGCUCUGCAUCCUGCUGCACGCUUUUCCGCAUCCGCGCGGUGACCAUCGACCGGGUG AUGAGCUACCUCAACGCCAGUUGAUAAUAGGCUGGAGCCUCGGUGGCCAUGCUUCU UGCCCCUUGGGCCUCCCCCCAGCCCCUCCUCCCCUUCCUGCACCCGUACCCCCCAA ACACCAUUGUCACACUCCAGUGGUCUUUGAAUAAAGUCUGAGUGGGCGGCAAAAAA AAAAAAAAAAAAAAAAAAAAAAAAAAAAAAAAAAAAAAAAAAAAAAAAAAAAAAAA AAAAAAAAAAAAAAAAAAAAAAAAAAAAAAAAAAAAAUCUAG G* = a 5' terminal guanosine cap |
| 169 | hIL12AB_029 (mRNA with T100 tail) | G*GGGAAAUAAGAGAGAAAAGAAGAGUAAGAAGAAAUAUAAGAGCCACCAUGUGCC ACCAACAGCUGGUGAUCAGCUGGUUCAGCCUGGUGUUUCUGGCCUCCCCUCUGGUG GCCAUCUGGGAGCUGAAGAAGGACGUGUACGUGGUGGAGCUGGACUGGUACCCUGA CGCCCCCGGCGAAAUGGUGGUGCUGACGUGCGACACCCCCGAGGAGGAUGGCAUCA CCUGGACCCUGGACCAAAGCAGCGAGGUCCUCGGAAGCGGCAAGACCCUCACUAUC CAAGUGAAGGAGUUCGGGGAUGCGGCCAGUACACCUGCCACAAGGGCGGCGAGGU GCUGUCUCAUAGCCUGCUGCUCCUGCAUAAGAAGGAAGACGGCAUCUGGAGCACCG ACAUACUGAAGGAUCAGAAGGAGCCCAAGAACAAGACCUUCCUGAGGUGCGAGGCC AAGAACUACUCCGGGCGCUUCACCUGUUGGUGGCUGACCACCAUCUCCACCGACCU GACCUUCAGCGUGAAGAGCAGCAGGGGGAGCAGCGACCCCCAGGGGGUGACCUGCG GAGCCGCGACCUUGUCGGCCGAGCGGGUGAGGGGCGACAAUAAGGAGUACGAGUAC UCGGUCGAAUGCCAGGAGGACUCCGCCUGCCCCGCCGCCGAGGAGUCCCUCCCCAU CGAAGUGAUGGUGGACGCCGUCCACAAGCUGAAGUACGAGAACUACACCAGCAGCU UCUUCAUACGGGAUAUCAUCAAGCCCGACCCCCCGAAGAACCUGCAGCUGAAACCC UUGAAGAACUCCAGGCAGGUGGAGGUGAGCUGGGAGUACCCCGACACCUGGUCCAC CCCGCACUCAUACUUCAGCCUGACCUUCUGUGUACAGGUCCAGGGCAAGAGCAAGA GGGAAAAGAAGGAUAGGGUGUUCACCGACAAGACCUCCGCCACGGUGAUCUGUCGG AAAAACGCCAGCAUCUCCGUGCGGGCCCAGGACAGGUACUAUUCCAGCAGCUGGAG CGAGUGGGCCUCCGUCCCCUGCUCCGGCGGCGGUGGCGGGGGCAGCAGGAACCUCC CCGUGGCCACCCCCGAUCCCGGGAUGUUCCCAUGCCUGCACCACAGCCAAAACCUG CUGAGGGCCGUCUCCAAUAUGCUGCAGAAGGCGAGGCAGACCCUGGAGUUCUACCC CUGUACCUCCGAGGAGAUCGACCACGAGGAUAUCACCAAGGACAAGACCUCCACGG UCGAGGCGUGCCUGCCCCUGGAGCUCACGAAGAACGAGAGCUGCCUUAACUCCAGG GAAACCUCGUUUAUCACGAACGGCAGCUGCCUGGCGUCACGGAAGACCUCCUUUAU GAUGGCCCUAUGUCUGUCCUCGAUCUACGAGGACCUGAAGAUGUACCAGGUGGAGU UCAAGACCAUGAACGCCAAGCUGCUGAUGGAUCCCAAGAGGCAGAUUUUCCUGGAC CAGAACAUGCUGGCCGUGAUUGACGAGCUGAUGCAGGCGCUGAACUUCAACAGCGA GACAGUGCCGCAGAAGAGCUCCCUGGAGGAGCCGGACUUUUACAAGACCAAGAUAA AGCUGUGCAUCCUGCUCCACGCCUUCAGAAUACGGGCCGUCACCAUCGAUAGGGUG AUGUCUUACCUGAACGCCUCCUGAUAAUAGGCUGGAGCCUCGGUGGCCAUGCUUCU UGCCCCUUGGGCCUCCCCCCAGCCCCUCCUCCCCUUCCUGCACCCGUACCCCCCAA ACACCAUUGUCACACUCCAGUGGUCUUUGAAUAAAGUCUGAGUGGGCGGCAAAAAA AAAAAAAAAAAAAAAAAAAAAAAAAAAAAAAAAAAAAAAAAAAAAAAAAAAAAAAA AAAAAAAAAAAAAAAAAAAAAAAAAAAAAAAAAAAAAUCUAG G* = a 5' terminal guanosine cap |
| 170 | hIL12AB_030 (mRNA with T100 tail) | G*GGGAAAUAAGAGAGAAAAGAAGAGUAAGAAGAAAUAUAAGAGCCACCAUGUGCC ACCAGCAGCUGGUGAUUAGCUGGUUUAGCCUGGUGUUCCUGGCAAGCCCCCUGGUG GCCAUCUGGGAACUGAAAAAGGACGUGUACGUGGUCGAGCUGGAUUGGUACCCCGA CGCCCCCGGCGAAAUGGUGGUGCUGACGUGUGAUACCCCCGAGGAGGACGGGAUCA CCUGGACCCUGGAUCAGAGCAGCGAGGUGCUGGGGAGCGGGAAGACCCUGACGAUC CAGGUCAAGGAGUUCGGCGACGCUGGGCAGUACACCUGUCACAAGGGCGGGGAGGU GCUGUCCCACUCCCUGCUGCUCCUGCAUAAGAAGGAGGACGGCAUCUGGUCCACCG ACAUCCUCAAGGACCAGAAGGAGCCCAAGAACAAGACCUUCCUGCGGUGUGAGGCG AAGAACUACAGCGGCCGUUUCACCUGCUGGUGGCUGACGACAAUCAGCACCGACUU GACGUUCUCCGUGAAGUCCUCCAGAGGCAGCUCCGACCCCCAAGGGGUGACGUGCG GCGCGGCCACCCUGAGCGCCGAGCGGGUGCGGGGGGACAACAAGGAGUACGAGUAC UCCGUGGAGUGCCAGGAGGACAGCGCCUGUCCCGCAGCCGAGGAGUCCCUGCCCAU CGAAGUCAUGGUGGACGCCGUCCACAAGCUGAAGUACGAGAACUACACCAGCAGCU UCUUCAUCCGCGAUAUCAUCAAGCCCGAUCCCCCAAAAAACCUGCAACUGAAGCCG CUGAAGAAUAGCAGGCAGGUGGAGGUGCCUGGGAGUACCCGGACACCUGGAGCAC GCCCCACAGCUAUUUCAGCCUGACCUUUUGCGUGCAGGUCCAGGGGAAGAGCAAGC GGGAGAAGAAGGACCGCGUGUUUACGGACAAAACCAGCGCCACCGUGAUCUGCAGG |

SUMMARY OF SEQUENCES

| SEQ ID NO | Description | Sequence |
|---|---|---|
| | | AAGAACGCCAGCAUCAGCGUGAGGGCCCAGGACAGGUACUACAGCAGCUCCUGGAG CGAGUGGGCCUCCGUGCCCUGUUCCGGAGGCGGCGGGGGCGGUUCCCGGAACCUCC CGGUGGCCACCCCCGACCCGGGCAUGUUCCCGUGCCUGCACCACUCACAGAAUCUG CUGAGGGCCGUGAGCAAUAUGCUGCAGAAGGCAAGGCAGACCCUGGAGUUUUAUCC CUGCACCAGCGAGGAGAUCGACCACGAAGACAUCACCAAGGACAAGACCAGCACAG UGGAGGCCUGCCUGCCCCUGGAACUGACCAAGAACGAGUCCUGUCUGAACUCCCGG GAAACCAGCUUCAUAACCAACGGCUCCUGUCUCGCCAGCAGGAAGACCAGCUUCAU GAUGGCCCUGUGCCUCAGCUCCAUCUACGAGGACCUCAAGAUGUACCAGGUUGAGU UCAAGACCAUGAACGCCAAGCUCCUGAUGGACCCCAAGAGGCAGAUCUUCCUGGAC CAGAAUAUGCUGGCCGUGAUCGAUGAGUUAAUGCAGGCGCUGAACUUCAACAGCGA GACGGUGCCCAAAAGUCCUCGCUGGAGGAGCCCGACUUCUACAAGACCAAGAUCA AGCUGUGCAUCCUCCUGCACGCCUUCCGAAUCCGGGCCGUAACCAUCGACAGGGUG AUGAGCUAUCUCAACGCCUCCUGAUAAUAGGCUGGAGCCUCGGUGGCCAUGCUUCU UGCCCCUUGGGCCUCCCCCAGCCCCUCCUCCCCUUCCUGCACCCGUACCCCCAA ACACCAUUGUCACACUCCAGUGGUCUUUGAAUAAAGUCUGAGUGGGCGGCAAAAAA AAAAAAAAAAAAAAAAAAAAAAAAAAAAAAAAAAAAAAAAAAAAAAAAAAAAAAAA AAAAAAAAAAAAAAAAAAAAAAAAAAAAAAAAAAAAAUCUAG G* = a 5' terminal guanosine cap |
| 171 | hIL12AB_031 (mRNA with T100 tail) | G*GGGAAAUAAGAGAGAAAAGAAGAGUAAGAAGAAAUAUAAGAGCCACCAUGUGCC ACCAGCAGCUCGUGAUCAGCUGGUUCUCGCUUGUGUUCCUGGCCUCCCCCUCGUC GCCAUCUGGGAGCUGAAGAAAGACGUGUACGUGGUGGAGCUGGACUGGUAUCCCGA CGCCCCGGGGGAGAUGGUGGUGCUGACCUGCGACACCCCGGAAGAGGACGGCAUCA CCUGGACGCUCGACCAGUCGUCCGAAGUGCUGGGGUCGGCCAAGACCCUCACCAUC CAGGUGAAGGAGUUCGGAGACGCCGGCCAGUACACCUGUCAUAAGGGGGGGGAGGU GCUGAGCCACAGCCUCCUGCUCCUGCACAAAAAGGAGGACGGCAUCUGGAGCACCG AUAUCCUCAAGGACCAGAAGGAGCCCAAGAACAAGACGUUCCUGAGGUGUGAGGCC AAGAACUACAGCGGGCGGUUCACGUGUUGGUGGCUCACCACCAUCUCCACCGACCU CACCUUCUCCGUGAAGUCAAGCAGGGGCAGCUCCGACCCCCAAGGCGUCACCUGCG GCGCCGCCACCCUGAGCGCCGAGAGGGUCAGGGGGGAUAACAAGGAAUACGAGUAC AGUGUGGAGUGCCAAGAGGAUAGCGCCUGUCCCGCCGCCGAAGAGAGCCUGCCCAU CGAAGUGAUGGUGGACGCCGUGCACAAGCUGAAGUACGAGAACUACACCUCCAGCU UCUUCAUCAGGGAUAUCAUCAAGCCCGAUCCCCCCAAGAACCUGCAGCUGAAGCCC CUGAAGAACAGCAGGCAGGUGGAGGUGAGCUGGGAGUAUCCCGACACGUGGAGCAC CCCGCACAGCUACUUCUCGCUGACCUUCUGCGUGCAGGUGCAAGGGAAGUCCAAGA GGGAGAAGAAGGAUAGGGUGUUCACCGACAAAACGAGCGCCACCGUGAUCUGCCGG AAGAAUGCCAGCAUCUCUGUGAGGGCCCAGGACAGGUACUAUUCCAGCUCCUGGUC GGAGUGGGCCAGCGUGCCCUGUAGCGGCGGGGGCGGGGCGGCAGCAGGAACCUCC CGGUUGCCACCCCCGACCCCGGCAUGUUUCCGUGCCUGCACCACUCGCAAAACCUG CUGCGCGCGGUCUCCAACAUGCUGCAAAAAGCGCGCCAGACGCUGGAGUUCUACCC CUGCACCAGCGAGGAGAUCGAUCAUGAAGAUAUCACCAAAGACAAGACCUCGACCG UGGAGGCCUGCCUGCCCCUGGAGCUCACCAAGAACGAAAGCUGCCUGAACAGCAGG GAGACAAGCUUCAUCACCAACGGCAGCUGCCUGGCCUCCCGGAAGACCAGCUUCAU GAUGGCCCUGUGCCUGUCCAGCAUCUACGAGGAUCUGAAGAUGUACCAAGUGGAGU UUAAGACCAUGAACGCCAAGCUGUUUAUGGACCCCAAAAGGCAGAUCUUCCUGGAU CAGAACAUGCUGGCCGUCAUCGACGAGCUGAUGCAAGCCCUGAACUUCAACAGCGA GACGGUGCCCCAGAAGAGCAGCCUCGAGGAGCCCGACUUCUAUAAGACCAAGAUAA AGCUGUGCAUUCUGCUGCACGCCUUCAGAAUCAGGGCCGUGACCAUCGAUAGGGUG AUGAGCUACCUGAACGCCAGCUGAUAAUAGGCUGGAGCCUCGGUGGCCAUGCUUCU UGCCCCUUGGGCCUCCCCCAGCCCCUCCUCCCCUUCCUGCACCCGUACCCCCAA ACACCAUUGUCACACUCCAGUGGUCUUUGAAUAAAGUCUGAGUGGGCGGCAAAAAA AAAAAAAAAAAAAAAAAAAAAAAAAAAAAAAAAAAAAAAAAAAAAAAAAAAAAAAA AAAAAAAAAAAAAAAAAAAAAAAAAAAAAAAAAAAAAUCUAG G* = a 5' terminal guanosine cap |
| 172 | hIL12AB_032 (mRNA with T100 tail) | G*GGGAAAUAAGAGAGAAAAGAAGAGUAAGAAGAAAUAUAAGAGCCACCAUGUGUC ACCAGCAGCUGGUGAUUUCCUGGUUCAGUCUGGUGUUUCUUGCCAGCCCCCUGGUG GCCAUCUGGGAGCUGAAGAAAGACGUAUACGUCGUGGAGCUGGACUGGUAUCCCGA CGCUCCCGGCGAGAUGGUGGUCCUCACCUGCGACACCCCAGAGGAGGACGGCAUCA CCUGGACCCUGGACCAGAGCUCCGAGGUCCUGGGCAGCGGUAAGACCCUCACCAUC CAGGUGAAGGAGUUUGGUGAUGCCGGCAGUAUACCUGCCACAAGGGCGGCGAGGU GCUGUCCCACAGCCUCCUGUUACUGCAUAAGAAGGAGGAUGGCAUCUGGAGCACCG ACAUCCUCAAGGACCAGAAAGAGCCCAAGAACAAGACCUUUCUGCGGUGCGAGGCG AAAAAUUACUCCGGCCGGUUCACCUGCUGGUGGCUGACCACCAUCAGCACGGACCU GACGUUCUCCGUGAAGUCGAGCAGGGGGAGCUCCGAUCCCCAGGGCGUGACCUGCG GCGCGGCCACCCUGAGCGCCGAGCGCGUCCGCGGGGACAAUAAGGAAUACGAAUAU AGCGUGGAGUGCCAGGAGGACAGCGCCUGCCCCGCGGCCGAGGAGAGCCUCCCGAU CGAGGUGAUGGUGGAUGCCGUCCACAAGCUCAAAUACGAAAACUACACCAGCAGCU UCUUCAUUAGGGACAUCAUCAAGCCCGACCCCCCCAAAAACCUGCAGCUGAAGCCC CUGAAGAACAGCCGCCAGGUCGAGGUGCAUGGGAGUACCCAGACACCUGGAGCAC CCCCACUCCUACUUCAGCCUGACCUUCUGCGUCCAGGUGCAGGGAAAGUCCAAAC GGGAGAAGAAGGAUAGGGUCUUUACCGAUAAAGAGUCGGCCACCGUCAUCUGCAGG AAGAACGCCAGCAUAAGCGUGCGGGCGCAGGAUCGGUACUACAGCUCGAGCUGGUC |

| SEQ ID NO | Description | Sequence |
|---|---|---|
| | | CGAAUGGGCCUCCGUGCCCUGUAGCGGAGGGGUGGCGGGGGCAGCAGGAACCUGC<br>CCGUGGCCACCCCGGACCCGGGCAUGUUUCCCUGCCUGCAUCACAGUCAGAACCUG<br>CUGAGGGCCGUGAGCAACAUGCUCCAGAAGGCCCGCCAGACCCUGGAGUUUUACCC<br>CUGCACCAGCGAAGAGAUCGAUCACGAAGACAUCACCAAAGACAAGACCUCCACCG<br>UGGAGGCCUGUCUGCCCCUGGAGCUGACCAAGAACGAGAGCUGUCUGAACAGCAGG<br>GAGACCUCCUUCAUCACCAACGGCUCCUGCCUGGCAUCCCGGAAGACCAGCUUCAU<br>GAUGGCCCUGUGUCUGAGCUCUAUCUACGAGGACCUGAAGAUGUACCAGGUCGAGU<br>UCAAGACCAUGAACGCCAAGCUGCUGAUGGACCCCAAGCGACAGAUAUUCCUGGAC<br>CAGAACAUGCUCGCCGUGAUCGAUGAACUGAUGCAAGCCCUGAACUUCAUAGCGA<br>GACCGUGCCCCAGAAAAGCAGCCUGGAGGAGCCCGACUUCUACAAGACCAAGAUCA<br>AACUGUGCAUACUGCUGCACGCGUUCAGGAUCCGGGCCGUCACCAUCGACCGGGUG<br>AUGUCCUAUCUGAAUGCCAGCUGAUAAUAGGCUGGAGCCUCGGUGGCCAUGCUUCU<br>UGCCCCUUGGGCCUCCCCCCAGCCCCUCCUCCCCUUCCUGCACCCGUACCCCCCAA<br>ACACCAUUGUCACACUCCAGUGGUCUUUGAAUAAAGUCUGAGUGGGCGGCAAAAAA<br>AAAAAAAAAAAAAAAAAAAAAAAAAAAAAAAAAAAAAAAAAAAAAAAAAAAAAA<br>AAAAAAAAAAAAAAAAAAAAAAAAAAAAAAAAAAAAAAAAAUCUAG G* = a 5'<br>terminal guanosine cap |
| 173 | hIL12AB_033<br>(mRNA with<br>T100 tail) | G*GGGAAAUAAGAGAGAAAAGAAGAGUAAGAAGAAAUAUAAGAGCCACCAUGUGCC<br>ACCAGCAGCUCGUGAUUAGCUGGUUUUUCGCUGGUGUUCCUGGCCAGCCCUCUCGUG<br>GCCAUCUGGGAGCUGAAAAAAGACGUGUACGUGGUGGAGCUGGACUGGUACCCGGA<br>CGCCCCCGGCGAGAUGGUGGUGCUGACGUGCGACACCCCGGAAGAGGACGGCAUCA<br>CCUGGACCCUGGACCAGUCAUCCGAGGUCCUGGGCAGCGGCAAGACGCUCACCAUC<br>CAGGUGAAGGAGUUCGGCGACGCCGGCCAGUACACAUGCCAUAAGGGCGGGGAGGU<br>GCUGAGCCACAGCCUGCUCCUCCUGCACAAGAAGGAGGAUGGCAUCUGGUCUACAG<br>ACAUCCUGAAGGACCAGAAAGAGCCCAAGAACAAGACCUUCCUCCGGUGCGAGGCC<br>AAGAACUACUCCGGGCGGUUUACUUGUUGGUGGCUGACCACCAUCAGCACCGACCU<br>CACCUUCAGCGUGAAGAGCUCCCGAGGGAGCUCCGACCCCCAGGGGGUCACCUGCG<br>GCGCCGCCACCCUGAGCGCCGAGCGGGUGAGGGGCGACAACAAGGAGUAUGAAUAC<br>AGCGUGGAAUGCCAAGAGGACAGCGCCUGUCCCGCGGCCGAGGAAAGCCUGCCCAU<br>CGAGGUGAUGGUGGACGCCGUCCACAAACUCAAGUACGAGAACUACACCAGCAGUU<br>UCUUCAUUCGCGACAUCAUCAAGCCGGACCCCCCCAAAAACCUGCAGCUCAAACCC<br>CUGAAGAACAGCAGGCAGGUGGAGGUCAGCUGGGAGUACCCGGACACCUGGAGCAC<br>CCCCCAUAGCUACUUCAGCCUGACCUUCUGCGUGCAGGUGCAGGGCAAGAGCAAAC<br>GCGAGAAGAAGGACCGGGUGUUUACCGACAAGACCAGCGCCACGGUGAUCUGCCGA<br>AAGAAUGCAAGCAUCUCCGUGAGGGCGCAGGACCGCUACUACUCUAGCAGCUGGAG<br>CGAGUGGGCCAGCGUGCCCUGCAGCGGUGGCGGCGGAGGCGGCAGCCGUAACCUCC<br>CCGUGGCCACCCCCGACCCCGGCAUGUUCCCGUGUCUGCACCACUCCCAGAACCUG<br>CUGAGGGCCGUCAGCAAUAUGCUGCAGAAGGCCCGGCAGACGCUGGAGUUCUACCC<br>CUGCACCUCCGAGGAGAUCGACCAUGAGGACAUUACCAAGGACAAGACGAGCACUG<br>UGGAGGCCUGCCUGCCCCUGGAGCUCACCAAAAACGAGAGCUGCCUGAAUAGCAGG<br>GAGACGUCCUUCAUCACCAACGGCAGCUGUCUGGCCAGCAGGAAGACCAGCUUCAU<br>GAUGGCCCUGUGCCUCUCCUCCAUAUAUGAGGAUCUGAAGAUGUACCAGGUGGAGU<br>UCAAGACCAUGAACGCCAAGCUGCUGAUGGAUCCCAAGAGGCAGAUCUUCCUGGAC<br>CAGAAUAUGCUGGCCGUGAUUGACGAGCUGAUGCAGGCCCUGAACUUUAAUAGCGA<br>GACCGUCCCCCAGAAGAGCAGCCUGGAGGAGCCCGACUUCUAUAAGACCAAGAUCA<br>AGCUGUGCAUACUGCUGCACGCGUUUAGGAUAAGGGCCGUCACCAUCGACAGGGUG<br>AUGAGCUACCUGAAUGCCAGCUGAUAAUAGGCUGGAGCCUCGGUGGCCAUGCUUCU<br>UGCCCCUUGGGCCUCCCCCCAGCCCCUCCUCCCCUUCCUGCACCCGUACCCCCCAA<br>ACACCAUUGUCACACUCCAGUGGUCUUUGAAUAAAGUCUGAGUGGGCGGCAAAAAA<br>AAAAAAAAAAAAAAAAAAAAAAAAAAAAAAAAAAAAAAAAAAAAAAAAAAAAAA<br>AAAAAAAAAAAAAAAAAAAAAAAAAAAAAAAAAAAAAUCUAG G* = a 5'<br>terminal guanosine cap |
| 174 | hIL12AB_034<br>(mRNA with<br>T100 tail) | G*GGGAAAUAAGAGAGAAAAGAAGAGUAAGAAGAAAUAUAAGAGCCACCAUGUGCC<br>ACCAACAGCUGGUGAUCUCCUGGUUCAGCCUGGUGUUCCUGCCAGCCCCCUGGUG<br>GCCAUCUGGGAGCUGAAGAAAGACGUGUACGUGGUGGAGCUGGAUUGGUACCCGA<br>CGCCCCCGGCGAGAUGGUCGUGCUGACCUGCGACACCCCGGAGGAGGACGGCAUCA<br>CCUGGACCCUGGAUCAGUCCUCCGAGGUCUGGGCAGCGGGAAGACCCUGACCAUC<br>CAGGUGAAAGAGUUCGGAGAUGCCGGCCAGUAUACCUGUCACAAGGGGGUGAGGU<br>GCUGAGCCAUAGCCUCUUGCUUCUGCACAAGAAGGAGGACGGCAUCUGGUCCACCG<br>ACAUCCUCAAGGACCAAAAGGAGCCGAAGAAUAAACGUUCCUGAGGUGCGAAGCC<br>AAGAACUAUUCCGGACGGUUCACCUGCUGGUGGCUGACCACCAUCAGCACCGACCU<br>CACCUUCUCCGUAAAGUCAAGCAGGGGCAGCUCCGACCCCCAGGGCGUGACCUGCG<br>GAGCCGCCACCCUGAGCGCAGAGAGGGUGAGGGGCGACAACAAGGAGUACGAAUAC<br>UCCGUCGAGUGCCAGGAGGACAGCGCCUGCCCCGCCGCCGAGGAAAGUCUGCCCAU<br>CGAGGUGAUGGUGGACGCCGUGCACAAGCUCAAAUACGAGAACUACACCAGCAGCU<br>UCUUCAUCCGGGAUAUCAUCAAGCCCGACCCUCCAAAGAAUCUGCAGCUGAAACCC<br>CUUAAGAACAGCAGGCAGGUGGAGGUCAGCUGGGAGUACCCCGACACCUGGAGCAC<br>GCCCCACUCCUACUUUAGCCUGACCUUUUGCGUGCAGGUGCAGGGGAAAAGCAAGC<br>GGGAGAAGAAGGACAGGGUGUUCACCGAUAAGACCUCCGCUACCGUGAUCUGCAGG<br>AAGAACGCCUCAAUCAGCGUGAGGGCCCAGGAUCGGUACUACUCCAGCUCCUGGAG<br>CGAGUGGGCCAGCGUGCCCUGCUCUGGCGGUGGCGGCGGGGGCAGCCGGAACCUGC |

| SUMMARY OF SEQUENCES | | |
|---|---|---|
| SEQ ID NO | Description | Sequence |
| | | CGGUGGCCACUCCCGACCCGGGCAUGUUCCCGUGCCUCCACCAUUCCCAGAACCUG CUGCGGGCCGUGUCCAAUAUGCUCCAGAAGGCAAGGCAGACCCUGGAGUUCUACCC CUGCACCAGCGAGGAGAUCGAUCACGAGGACAUCACCAAAGACAAAACCAGCACGG UCGAGGCCUGCCUGCCCCUGGAACUCACCAAGAACGAAAGCUGUCUCAACAGCCGC GAGACCAGCUUCAUAACCAACGGUUCCUGUCUGGCCUCCCGCAAGACCAGCUUUAU GAUGGCCCUCUGUCUGAGCUCCAUCUAUGAAGACCUGAAAAUGUACCAGGUGGAGU UCAAAACCAUGAACGCCAAGCUUCUGAUGGACCCCAAGAGGCAGAUCUUCCUGGAU CAGAACAUGCUGGCCGUGAUCGACGAGCUGAUGCAGGCCCUGAACUUUAACUCCGA GACCGUGCCCCAGAAAAGCAGCCUGGAAGAGCCCGAUUUCUACAAAACGAAGAUCA AGCUGUGCAUCCUGCUGCACGCCUUCCGGAUCCGUGCGGUGACCAUCGAUAGGGUG AUGAGCUACCUGAACGCCAGCUGAUAAUAGGCUGGAGCCUCGGUGGCCAUGCUUCU UGCCCCUUGGGCCUCCCCCCAGCCCCUCCUCCCCUUCCUGCACCCGUACCCCCAA ACACCAUUGUCACACUCCAGUGGUCUUUGAAUAAAGUCUGAGUGGGCGGCAAAAAA AAAAAAAAAAAAAAAAAAAAAAAAAAAAAAAAAAAAAAAAAAAAAAAAAAAAAAAA AAAAAAAAAAAAAAAAAAAAAAAAAAAAAAAAAAAAAUCUAG G* = a 5' terminal guanosine cap |
| 175 | hIL12AB_035 (mRNA with T100 tail) | G*GGGAAAUAAGAGAGAAAAGAAGAGUAAGAAGAAAUAUAAGAGCCACCAUGUGCC ACCAACAGCUGGUAAUCAGCUGGUUCAGCCUGGUUUUCCUCGCGUCGCCCCUGGUG GCCAUCUGGGAGUUAAAGAAGGACGUGUACGUGGUGGAGCUGGAUUGGUACCCCGA CGCCCCGGGCGAGAUGGUCGUGCUCACCUGCGAUACCCCCGAGGAGGACGGGAUCA CCUGGACCCUGGACCAAUCCAGCGAGGUGCUGGGCAGCGGCAAGACCCUGACCAUA CAGGUGAAGGAAUUUGGGGACGCCGGGCAGUACACCUGCCACAAGGGCGGGGAAGU GCUGUCCCACUCCCUCCUGCUGCUGCAUAAGAAGGAGGACGGCAUCUGGAGCACCG ACAUCCUGAAGGACCAAAAGGAGCCCAAGAACAAGACCUUCCUGAGGUGCGAGGCC AAAAACUAUUCCGGCCGCUUUACCUGUUGGUGGCUGACCACCAUCUCCACCGAUCU GACCUUCAGCGUGAAGUCGUCUAGGGGCUCCUCCGACCCCCAGGGCGUAACCUGCG GCGCCGCGACCCUGAGCGCCGAGAGGGUGCGGGGCGAUAACAAAGAGUACGAGUAC UCGGUGGAGUGCCAGGAGGACAGCGCCUGUCCGGCGGCCGAGGAGAGCCUGCCCAU CGAGGUGAUGGUGGACGCCGUCCACAAGCUGAAGUACGAGAACUACACCAGUUCGU UCUUCAUCAGGGACAUCAUCAAGCCGGACCCCCCCAAGAACCUCCAGCUGAAGCCC CUGAAGAACAGCAGGCAGGUGGAAGUGUCCUGGGAGUAUCCCGACACCUGGAGCAC CCCCCACAGCUACUUCAGCCUGACCUUUUGCGUGCAGGUGCAGGGCAAAAGCAAGA GGGAAAAGAAGGACCGGGUGUUCACCGAUAAGACGAGCGCCACCGUUAUCUGCAGG AAGAACGCCUCCAUAAGCGUGAGGGCGCAGGACCGUUACUACAGCAGCAGCUGGAG UGAGUGGGCAAGCGUGCCCUGUAGCGGCGGGGGCGGGGCGGGUCCCGCAACCUCC CCGUCGCCACCCCCGACCCAGGCAUGUUUCCUGCCUGCACCACAGCCAGAACCUG CUGCGGGCCGUUAGCAACAUGCUGCAGAAGGCCAGGCAGACCCUCGAGUUCUAUCC CUGCACAUCUGAGGAGAUCGACCACGAAGACAUCACUAAGGAUAAGACCUCCACCG UGGAGGCCUGUCUGCCCCUCGAGCUGACCAAGAAUGAAUCCUGCCUGAACAGCCGA GAGACCAGCUUUAUCACCAACGGCUCCUGCCUGGCCAGCAGGAAGACCUCCUUCAU GAUGGCCCUGUGCCUCUCCCAGCAUCUACGAGGAUCUGAAGAUGUACCAGGUAGAGU UCAAGACGAUGAACGCCAAGCUCCUGAUGGACCCCAAGAGGCAGAUAUUCCUGGAC CAGAACAUGCUGGCGGUGAUCGACGAGCUGAUGCAGGCCCUGAAUUUCAACAGCGA GACGGUGCCACAGAAGUCCAGCCUGGAGGAGCCCAGACUUCUACAAGACCAAGAUCA AACUGUGCAUCCUCCUGCACGCGUUCAGGAUCCGCGCCGUCACCAUAGACAGGGUG AUGAGUUAUCUGAACGCCAGCUGAUAAUAGGCUGGAGCCUCGGUGGCCAUGCUUCU UGCCCCUUGGGCCUCCCCCAGCCCCUCCUCCCCUUCCUGCACCCGUACCCCCAA ACACCAUUGUCACACUCCAGUGGUCUUUGAAUAAAGUCUGAGUGGGCGGCAAAAAA AAAAAAAAAAAAAAAAAAAAAAAAAAAAAAAAAAAAAAAAAAAAAAAAAAAAAAAA AAAAAAAAAAAAAAAAAAAAAAAAAAAAAAAAAAAAAUCUAG G* = a 5' terminal guanosine cap |
| 176 | hIL12AB_036 (mRNA with T100 tail) | G*GGGAAAUAAGAGAGAAAAGAAGAGUAAGAAGAAAUAUAAGAGCCACCAUGUGCC AUCAGCAGCUGGUAAUCAGCUGGUUUAGCCUGGUGUUCCUGGCCAGCCCACUGGUG GCCAUCUGGGAGCUGAAGAAGGACGUGUACGUGGUGGAACUGGACUGGUACCCCGA CGCCCCUGGCGAGAUGGUGGUACUGACCUGUGACACCCCGGAGGAAGACGGUAUCA CCUGGACCCUGGAUCAGAGCUCCGAGGUGCUGGGCUCCGGCAAGACACUGACCAUC CAAGUUAAGGAAUUUGGGGACGCCGGCCAGUACACCUGCCACAAGGGGGCGAGGU GCUGUCCCACUCCCUGCUGCUUCUGCAUAAGAAGGAGGAUGGCAUCUGGUCCACCG ACAUACUGAAGGACCAGAAGGAGCCCAAGAAUAAGACCUUCCUGAGAUGCGAGGCC AAGAACUACUCGGAAGGUUCACCUGCUGGUGGCUGACCACCAUCAGCACCGACCU GACCUUCUCCGUGAAGAGCUCCCGGGGCAGCUCCGACCCCCAGGGCGUAACCUGUG GGGCCGCUACCCUGUCCGCCGAGAGGGUCCGGGGCGACAACAAGGAAUACGAGUAC AGCGUGGAGUGCCAGGAGGACUCCGCCUGCCCCGCCGCCGAGGAGUCGCUGCCCAU AGAGGUGAUGGUGGACGCCGUGCACAAGCUCAAGUACGAGAAUUACACCAGCAGCU UCUUUAUCAGGGACAUAAUUAAGCCGGACCCCCCAAAGAAUCUGCAGCUGAAGCCC CUGAAGAAUAGCCGGCAGGUGGAAGUGUCCUGGGAGUACCCCGACACCUGGAGCAC CCCCACUCCUAUUUCUCACUGACAUUCUGCGUGCAGGUGCAAGGGAAAAGCAAGA GGGAGAAGAAGGAUAGGGUGUUCACCGACAAGACAAGCGCCACCGUGAUCUGCCGA AAAAAUGCCAGCAUCAGCGUGAGGGCCCAGGAUCGGUAUUACAGCAGCUCCUGGAG CGAGUGGGCAGCGUGCCCUGUUCCGGCGGGGAGGGGCGGCUCCCGGAACCUGC CGGUGGCCACCCCCGACCCUGGCAUGUUCCCCUGCCUGCAUCACAGCCAGAACCUG |

-continued

SUMMARY OF SEQUENCES

| SEQ ID NO | Description | Sequence |
|---|---|---|
| | | CUCCGGGCCGUGUCGAACAUGCUGCAGAAGGCCCGGCAGACCCUCGAGUUUUACCC CUGCACCAGCGAAGAGAUCGACCACGAAGACAUAACCAAGGACAAGACCAGCACGG UGGAGGCCUGCCUGCCCCUGGAGCUUACCAAAAACGAGUCCUGCCUGAACAGCCGG GAAACCAGCUUCAUAACGAACGGGAGCUGCCUGGCCUCCAGGAAGACCAGCUUCAU GAUGGCGCUGUGUCUGUCCAGCAUAUACGAGGAUCUGAAGAUGUAUCAGGUGGAAU UCAAAACUAUGAAUGCCAAGCUCCUGAUGGACCCCAAGAGGCAGAUCUUCCUGGAC CAGAACAUGCUAGCCGUGAUCGACGAGCUGAUGCAGGCCCUCAACUUCAACUCGGA GACGGUGCCCCAGAAGUCCAGCCUCGAGGAGCCCGACUUCUACAAGACCAAGAUCA AGCUGUGCAUACUGCUGCAUGCCUUCAGGAUAAGGGCGGUGACUAUCGACAGGGUC AUGUCCUACCUGAACGCCAGCUGAUAAUAGGCUGGAGCCUCGGUGGCCAUGCUUCU UGCCCCUUGGGCCUCCCCCCAGCCCCUCCUCCCCUUCCUGCACCCGUACCCCCCAA ACACCAUUGUCACACUCCAGUGGUCUUUGAAUAAAGUCUGAGUGGGCGGCAAAAAA AAAAAAAAAAAAAAAAAAAAAAAAAAAAAAAAAAAAAAAAAAAAAAAAAAAAAAAA AAAAAAAAAAAAAAAAAAAAAAAAAAAAAAAAAAAAAAAAAUCUAG G* = a 5' terminal guanosine cap |
| 177 | hIL12AB_037 (mRNA with T100 tail) | G*GGGAAAUAAGAGAGAAAAGAAGAGUAAGAAGAAAUAUAAGAGCCACCAUGUGCC ACCAACAACUGGUGAUCAGCUGGUUCUCCCUGGUGUUCCUGGCCAGCCCCCUGGUG GCCAUCUGGGAGCUCAAAAAAGACGUGUACGUGGUGGAGCUCGAUUGGUACCCAGA CGCGCCGGGGAAAUGGUGGUGCUGACCUGCGACACCCCAGAGGAGGAUGGCAUCA CGUGGACGCUGGAUCAGUCCAGCGAGGUGCUGGGGAGCGGCAAGACGCUCACCAUC CAGGUGAAGGAAUUUGGCGACGCGGGCCAGUAUACCUGUCACAAGGGCGGCGAGGU GCUGAGCCACUCCCUGCUGCUGCUGCACAAGAAGGAGGAUGGGAUCUGGUCAACCG AUAUCCUGAAAGACCAGAAGGAGCCCAAGAACAAGACCUUCCUGCGCUGCGAGGCC AAGAACUAUAGCGGCAGGUUCACCUGCUGGUGGCUGACCACCAUCAGCACCGACCU GACCUUCAGCGUGAAAUCCUCCAGGGGCAGCAGCGACCCCCAGGGCGUGACCUGCG GUGCCGCCACGCUCUCCGCCGAGCGAGUGAGGGGUGACAACAAGGAGUACGAGUAC AGCGUGGAAUGUCAGGAGGACAGCGCCUGUCCCGCCGCCGAGGAGUCCUGCCCAU CGAGGUGAUGGUCGACGCGGUGCACAAGCUCAAAUACGAGAAUUACACCAGCAGCU UCUUCAUCAGGGACAUCAUCAAGCCCGACCCCCCCAAGAACCUGCAGCUGAAGCCC UUGAAGAACAGCAGGCAGGUGGAGGUGAGCUGGGAGUACCCGGACACCUGGAGCAC CCCCCACUCCUACUUCAGCCUGACGUUCUGUGUGCAGGUGCAGGGGAAGUCCAAGA GGGAGAAGAAGGACCGGGUGUUCACCGACAAGACCAGCGCCACCGUGAUAUGCCGC AAGAACGCGUCCAUCAGCGUUCGCGCCCAGGACCGCUACUACAGCAGCUCCUGGUC CGAAUGGGCCAGCGUGCCCUGCAGCGGUGGAGGGGGCGGGGGCUCCAGGAAUCUGC CGGUGGCCACCCCCGACCCCGGGAUGUUCCCGUGUCUGCAUCACUCCCAGAACCUG CUGCGGGCCGUGAGCAAUAUGCUGCAGAAGGCCAGGCAGACGCUCGAGUUCUACCC CUGCACCUCCGAAGAGAUCGACCAUGAGGACAUCACCAAGGACAAGACCAGCACCG UGGAGGCCUGCCUCCCCCUGGAGCUGACCAAAAACGAGAGCUGCCUGAACUCCAGG GAGACCAGCUUUAUAACCAACGGCAGCUGCCUCGCCUCCAGGAAGACCUCGUUUAU GAUGGCCCUCUGCCUGUCCAGCAUCUACGAGGACCUGAAGAUGUACCAGGUGGAGU UCAAGACCAUGAACGCGAAGUUGCUCAUGGACCCCAAGAGGCAGAUCUUCCUGGAC CAGAACAUGCUCCGGGUGAUCGACGAGCUGAUGCAAGCCCUGAACUUCAACAGCGA GACCGUGCCCCAGAAGAGCAGCCUGGAAGAGCCCGACUUCUACAAGACCAAGAUCA AGCUGUGCAUCCUGCUGCACGCCUUCCGGAUCCGGGCCGUGACCAUCGACAGGGUG AUGAGCUACCUCAACGCCUCCUGAUAAUAGGCUGGAGCCUCGGUGGCCAUGCUUCU UGCCCCUUGGGCCUCCCCCCAGCCCCUCCUCCCCUUCCUGCACCCGUACCCCCCAA ACACCAUUGUCACACUCCAGUGGUCUUUGAAUAAAGUCUGAGUGGGCGGCAAAAAA AAAAAAAAAAAAAAAAAAAAAAAAAAAAAAAAAAAAAAAAAAAAAAAAAAAAAAAA AAAAAAAAAAAAAAAAAAAAAAAAAAAAAAAAAAAAAAAAAUCUAG G* = a 5' terminal guanosine cap |
| 178 | hIL12AB_038 (mRNA with T100 tail) | G*GGGAAAUAAGAGAGAAAAGAAGAGUAAGAAGAAAUAUAAGAGCCACCAUGUGCC ACCAGCAGCUCGUGAUCAGCUGGUUCUCCCUCGUCUUCCUGGCCUCCCCGCUGGUG GCCAUCUGGGAGCUGAAGAAGGACGUGUACGUGGUGGAGCUGGACUGGUAUCCCGA CGCCCCGGCGAGAUGGUGGUGCUGACGUGCGACACACCAGAAGAGGACGGGAUCA CAUGGACCCUGGAUCAGUCGUCCGAGGUGCUGGGGAGCGGCAAGACCCUCACCAUC CAAGUGAAGGAGUUCGGGGACGCCGGCCAGUACACCUGCCACAAGGGCGGGGAGGU GCUCUCCCAUAGCCUGCUCCUCCUGCACAAAAAGGAGGAUGGCAUCUGGAGCACCG ACAUCCUGAAGGACCAGAAGGAGCCCAAGAACAAGACAUUUCUCAGGUGUGAGGCC AAGAACUAUUCGGGCAGGUUUACCUGUUGGUGGCUCACCACCAUCUCUACCGACCU GACGUUCUCCGUCAAGUCAAGCAGGGGGAGCUCGACCCCCAGGGGGUGACAUGUG GGGCCGCCACCCUGAGCGCGAGCGUGCCGCGGCGACAACAAGGAGUACGAGUAU UCCGUGGAGUGCCAGGAGGACAGCGCCUGCCCCGCCGCCGAGGAGUCCCUGCCCAU AGAGGUGAUGGUGGACGCCGUCCACAAGUUGAAGUACGAAAAUUAUACCUCCUCGU UCUUCAUUAGGGACAUCAUCAAGCCUGACCCCCCGAAGAACCUACAACUCAAGCCC CUCAAGAACUCCCGCCAGGUGGAGGUGUCCUGGGAGUACCCCGACACCUGGUCCAC CCCGCACAGCUACUUCAGCCUGACCUUCUGCGUGCAGGUCCAGGGGAAGAGCAAGC GUGAAAAGAAAGACAGGGUGUUCACCGACAAGACGAGCGCCACCGUGAUCUGCAGG AAAAACGCCUCCAUCUCCGUGCGCGCCCAGGACAGGUACUACAGUAGCUCCUGGAG CGAAUGGGCCAGCGUGCCGUGCAGCGGCGGGGAGGAGGCGGCAGUCGCAACCUGC CCGUGGCCACCCCCGACCCCGGCAUGUUCCCAUGCCUGCACCACAGCCAGAACCUG CUGAGGGCAGUCAGCAAUAUGCUGCAGAAGGCCAGGCAGACCCUGGAGUUUUAUCC |

SUMMARY OF SEQUENCES

| SEQ ID NO | Description | Sequence |
|---|---|---|
| | | CUGCACCAGCGAGGAGAUCGACCACGAGGACAUCACCAAGGACAAGACCUCCACCG UCGAGGCCUGCCUGCCACUGGAGCUGACCAAAAACGAGAGCUGCCUGAACUCCAGG GAGACCUCCUUCAUCACCAACGGGAGCUGCCUGGCCAGCCGGAAGACCAGCUUCAU GAUGGCGCUGUGCCUCAGCAGCAUCUACGAGGAUCUCAAGAUGUACCAGGUGGAGU UCAAGACCAUGAACGCGAAGCUGCUGAUGGACCCCAAGCGGCAGAUCUUCCUGGAC CAGAACAUGCUGGCCGUGAUUGACGAGCUCAUGCAGGCCCUGAACUUCAAUAGCGA GACCGUCCCCAAAAGAGCAGCCUGGAGGAACCCGACUUCUACAAAACGAAGAUCA AGCUCUGCAUCCUGCUGCACGCCUUCCGGAUCCGGGCCGUGACCAUCGAUCGUGUG AUGAGCUACCUGAACGCCUCGUGAUAAUAGGCUGGAGCCUCGGUGGCCAUGCUUCU UGCCCCUUGGGCCUCCCCCCAGCCCCUCCUCCCCUUCCUGCACCCGUACCCCCCAA ACACCAUUGUCACACUCCAGUGGUCUUUGAAUAAAGUCUGAGUGGGCGGCAAAAAA AAAAAAAAAAAAAAAAAAAAAAAAAAAAAAAAAAAAAAAAAAAAAAAAAAAAAAAA AAAAAAAAAAAAAAAAAAAAAAAAAAAAAAAAAAAAAAAAAUCUAG G\* = a 5' terminal guanosine cap |
| 179 | hIL12AB_039 (mRNA with T100 tail) | G\*GGGAAAUAAGAGAGAAAAGAAGAGUAAGAAGAAAUAUAAGAGCCACCAUGUGCC ACCAGCAGCUCGUCAUCUCCUGGUUUAGCCUGGUGUUUCUGGCCUCCCCCCUGGUC GCCAUCUGGGAGCUGAAGAAAGACGUGUACGUGGUGGAGCUGGACUGGUACCCGGA CGCUCCCGGGGAGAUGGUGGUGCUGACCUGCGACACCCCCGAGGAGGACGGCAUCA CCUGGACCCUGGACCAGAGCUCCGAGGUGCAUGGGGAGCGGCAAGACCCUGACCAUU CAGGUGAAAGAGUUCGGCGACGCCGGCCAAUAUACCUGCCACAAGGGGGGGGAGGU CCUGUCGCAUUCCCUGCUGCUGCUUCACAAAAAGGAGGAUGGCAUCUGGAGCACCG ACAUCCUGAAGGACCAGAAAGAACCCAAGAACAAGACGUUCCUGCGCUGCGAGGCC AAGAACUACAGCGGCCGGUUCACCUGUUGGUGGCUGACCACCAUCUCCACCGACCU GACUUUCUCGGUGAAGAGCAGCCGCGGGAGCAGCGACCCCCAGGGAGUGACCUGCG GCGCCGCCACCCUGAGCGCCGAAAGGGUGAGGGGCGACAAUAAAGAGUACGAGUAU UCCGUGGAGUGCCAGGAGGACAGCGCCUGUCCCGCCGCCGAGGAGUCCCUGCCUAU CGAGGUGAUGGUCGACGCGGUGCACAAGCUCAAGUACGAAAACUACACCAGCAGCU UUUUCAUCAGGGAUAUCAUCAAACCAGACCCCCCCAAGAACCUGCAGCUGAAGCCC CUGAAAAACAGCAGGCAGGUGGAAGUGAGCUGGGAAUACCCCGAUACCUGGUCCAC CCCCCACAGCUACUUCAGCCUGACCUUCUGCGUGCAGGUGCAGGGGAAGUCCAAGC GGGAGAAGAAAGAUCGGGUGUUCACGGACAAGACCAGCGCCACCGUGAUUUGCAGG AAAAACGCCAGCAUCUCCGUGAGGGCUCAGGACAGGUACUACAGCUCCAGCUGGAG CGAGUGGGCCUCCGUGCCUUGCAGCGGGGAGGAGGCGGCGGCAGCAGGAAUCUGC CCGUCGCAACCCCCGACCCCGGCAUGUUCCCUGCCUGCACCACAGCCAGAAUCUG CUGCGAGCCGUGAGCAACAUGCUCCAGAAGGCCCGGCAGACGCUGGAGUUCUACCC CUGCACCUCCGAGGAGAUCGACCACGAGGACAUCACCAAGGAUAAGACGAGCACCG UCGAGGCCUGUCUCCCCCUGGAGCUCACCAAGAACGAGUCCUGCCUGAAUAGCAGG GAGACGUCCUUCAUAACCAACGGCAGCUGUCUGGCGUCCAGGAAGACCAGCUUCAU GAUGGCCCUCUGCCUGAGCUCCAUCUACGAGGACCUCAAGAUGUACCAGGUCGAGU UCAAGACCAUGAACGCAAAACUGCUUCAUGGAUCCAAAGAGGCAGAUCUUUCUGGAC CAGAACAUGCUGGCCGUGAUCGAUGAACUCAUGCAGGCCCUGAAUUUCAAUUCCGA GACCGUCCCCAGAAGAGCUCCCUGGAGGAACCCGACUUCUACAAAACAAAGAUCA AGCUGUGUAUCCUCCUGCACGCCUUCCGGAUCAGGGCCGUCACCAUUGACCGGGUG AUGUCCUACCUGAACGCCAGCUGAUAAUAGGCUGGAGCCUCGGUGGCCAUGCUUCU UGCCCCUUGGGCCUCCCCCCAGCCCCUCCUCCCCUUCCUGCACCCGUACCCCCCAA ACACCAUUGUCACACUCCAGUGGUCUUUGAAUAAAGUCUGAGUGGGCGGCAAAAAA AAAAAAAAAAAAAAAAAAAAAAAAAAAAAAAAAAAAAAAAAAAAAAAAAAAAAAAA AAAAAAAAAAAAAAAAAAAAAAAAAAAAAAAAAAAAAAAAAUCUAG G\* = a 5' terminal guanosine cap |
| 180 | hIL12AB_040 (mRNA with T100 tail) | G\*GGGAAAUAAGAGAGAAAAGAAGAGUAAGAAGAAAUAUAAGAGCCACCAUGUGCC AUCAGCAGCUGGUGAUCAGCUGGUUCAGCCUGGUGUUCCUGGCCUCCCCCAGCCCCUCCUCCCUCCCUGGCUCCCCCCUGGUC GCCAUCUGGGAGCUGAAAAAGGACGUGUACGUGGUGGAGCUGGACUGGUAUCCCGA CGCCCCGGGCGAGAUGGUGGUGCUGACCUGCGACACCCCCGAGGAGGACGGCAUUA CCUGGACACUGGACCAGAGCAGCGAGGUCCUGGGCAGCGGGAAGACCCUGACAAUU CAGGUGAAGGAGUUCGGCGACGCGGACAGUACACGUGCCACAAGGGGGGGGAGGU GCUGUCCCACAGCCUCCUCCUGCUGCACAAGAAGGAGGAUGGCAUCUGGAGCACCG ACAUCCUGAAGGAUCAGAAGGAGCCCAAGAACAAGACCUUUCUGAGAUGCGAGGCC AAGAAUUACAGCGGCCGUUUCACCUGCUGGUGGCUCACCACCAUCAGCACCGACCU GACCUUCAGCGUGAAAUCCUCCAGGGGCUCCUCCGACCCGCAGGGAGUGACCUGCG GCGCCGCCACACUGAGCGCCGAGCGGGUCAGAGGGGACAACAAGGAGUACGAGUAC AGCGUUGAGUGCCAGGAGGACAGCGCCUGUCCCGCGGCCGAGGAAUCCCUGCCCAU CGAGGUGAUGGUGGACGCAGUGCACAAGCUGAAGUACGAGAACUAUACCUCGAGCU UCUUCAUCCGGGAUAUCAUUAAGCCCGAUCCCCCGAAGAACCUGCAGCUCAAACCC CUGAAGAACAGCAGGCAGGUGGAGGUCUCCUGGGAGUACCCCGACACAUGGUCCAC CCCCCAUUCCUAUUUCUCCCUGACCUUUUGCGUGCAGGUGCAGGGCAAGAGCAAGA GGGAGAAAAAGGACAGGGUGUUCACCGACAAGACCUCCGCCACCGUGAUCUGCCGU AAGAACGCUAGCAUCAGCGUCAGGGCCCAGGACAGGUACUAUAGCAGCUCCUGGUC CGAGUGGGCCAGCGUCCCGUGCAGCGGCGGGGCGGUGGAGGCUCCCGGAACCUCC CCGUGGCCACCCCGGACCCCGGGAUGUUCCCUGCCUGCAUCACAGCCAGAACCUG CUGAGGGCCUGUGUCCAACAUGCUGCAGAAGGCCAGGCAGACACUCGAGUUUUACCC CUGCACCAGCGAGGAGAUCGACCACGAAGACAUCACCAAGGACAAGACCUCCACCG |

| SEQ ID NO | Description | Sequence |
|---|---|---|
| | | UGGAGGCAUGCCUGCCCCUGGAGCUGACCAAAAACGAAAGCUGUCUGAACUCCAGG GAGACCUCCUUUAUCACGAACGGCUCAUGCCUGGCCUCCAGAAAGACCAGCUUCAU GAUGGCCCUGUGCCUGAGCUCCAUCUACGAGGACUUGAAAAUGUACCAGGUCGAGU UCAAGACCAUGAACGCCAAGCUGCUCAUGGACCCCAAAAGGCAGAUCUUUCUGGAC CAGAAUAUGCUGGCCGUGAUCGACGAGCUCAUGCAAGCCCUGAAUUUCAACAGCGA GACCGUGCCCCAGAAGUCCUCCCUGGAGGAGCCCGACUUCUACAAGACCAAGAUCA AGCUGUGCAUACUCCUGCACGCGUUUAGGAUCAGGGCGGUGACCAUCGAUAGGGUG AUGAGCUACCUGAUGCCUCCUGAUAAUAGGCUGGAGCCUCGGUGGCCAUGCUUCU UGCCCCUUGGGCCUCCCCCCAGCCCCUCCUCCCCUUCCUGCACCCGUACCCCCCAA ACACCAUUGUCACACUCCAGUGGUCUUUGAAUAAAGUCUGAGUGGGCGGCAAAAA AAAAAAAAAAAAAAAAAAAAAAAAAAAAAAAAAAAAAAAAAAAAAAAAAAAAAAA AAAAAAAAAAAAAAAAAAAAAAAAAAAAAAAAAAAAAAAAAUCUAG G* = a 5' terminal guanosine cap |
| 181 | mIL12AB 80TM- nolinker_ V5_ Nucleotide Sequence | ATGTGTCCTCAGAAGCTAACCATCTCCTGGTTTGCCATCGTTTTGTTGGTGTCTCC ACTCATGGCCATGTGGGAGCTCGAGAAAGACGTTTACGTTGTAGAGGTGGACTGGA CTCCCGACGCCCCGGGCGAAACAGTGAACCTCACCTGTGACACGCCTGAAGAAGAT GACATCACCTGGACCTCAGACCAGAGACATGGAGTCATAGGCTCTGGAAAGACCCT GACCATCACTGTCAAAGAGTTCCTAGATGCTGGCCAGTACACCTGCCACAAAGGAG GCGAGACTCTGAGCCACTCACATCTGCTGCTCCACAAGAAGGAGAATGGAATTTGG TCCACTGAGATCCTGAAGAACTTCAAGAATAAGACTTTCCTGAAGTGTGAAGCACC AAATTACTCCGGACGGTTCACGTGCTCATGGCTGGTGCAAAGAAACATGGACTTGA AGTTCAACATCAAGAGCAGTAGCAGTTCCCCTGACTCTCGGGCAGTGACATGTGGA ATGGCGTCTCTGTCTGCAGAGAAGGTCACACTGGACCAAAGGGACTATGAGAAGTA TTCAGTGTCCTGCCAGGAGGATGTCACCTGCCCAACTGCCGAGGAGACACTGCCCA TTGAACTGGCGTTGGAAGCACGGCAGCAGAATAAATATGAGAACTACAGCACCAGC TTCTTCATCAGGGACATCATCAAACCAGACCCGCCCAAGAACTTGCAGATGAAGCC TTTGAAGAACTCACAGGTGGAGGTCAGCTGGGAGTACCCGGACTCCTGGAGCACTC CCCATTCCTACTTCTCCCTCAAGTTCTTTGTTCGAATCCAGCGCAAGAAAGAGAAG ATGAAGGAGACAGAGGAGGGGTGTAACCAGAAAGGTGCGTTCCTCGTAGAGAAGAC ATCTACCGAAGTCCAATGCAAAGGCGGGAATGTCTGCGTGCAAGCTCAGGATCGCT ATTACAATTCCTCATGCAGCAAGTGGGCATGTGTTCCCTGCAGGGTCCGATCCGGA GGCGGAGGGAGCGGTGGTGGAGGCAGCGGAGGAGGTGGATCAAGGGTCATTCCAGT CTCTGGACCAGCTAGATGTCTTAGCCAGTCCCGAAACCTGCTGAAGACCACGGACG ACATGGTGAAGACGGCCAGAGAGAAACTGAAACATTATTCCTGCACCGCAGAGGAT ATCGATCACGAAGATATCACACGGGACCAAACCAGCACATTGAAGACCTGTTTACC ACTGGAACTACACAAGAACGAGAGTTGCCTGGCTACTAGAGAGACTTCTTCCACAA CAAGAGGGAGCTGCCTGCCACCACAGAAGACGTCTTTGATGATGACCCTGTGCCTT GGTAGCATCTATGAGGACCTCAAGATGTACCAGACAGAGTTCCAGGCCATCAACGC AGCACTTCAGAATCACAACCATCAGCAGATCATTTTAGACAAGGGCATGCTGGTGG CCATCGATGAGCTGATGCAATCATTGAATCATAACGGTGAGACATTGCGCCAGAAA CCTCCTGTGGGAGAAGCAGACCCTTACAGAGTGAAGATGAAGCTCTGCATCCTGCT TCACGCCTTCAGCACCCGCGTCGTCACTATCAACAGGGTGATGGGCTATCTGAGCT CCGCCACCCTGGTGCTGTTCGGCGCCGGCTTCGGTGCAGTGATCACCGTGGTGGTG ATCGTCGTCATCATCGGGAAACCAATTCCAAATCCCCTCCTGGGGTTGGATAGCAC C |
| 182 | mIL12AB- 80TM- nolinker_V5 Amino acid Sequence | *MCPQKLTISWFAIVLLVSPLMA*MWELEKDVYVVEVDWTPDAPGETVNLTCDTPEED DITWTSDQRHGVIGSGKTLTITVKEFLDAGQYTCHKGGETLSHSHLLLHKKENGIW STEILKNFKNKTFLKCEAPNYSGRFTCSWLVQRNMDLKFNIKSSSSSPDSRAVTCG MASLSAEKVTLDQRDYEKYSVSCQEDVTCPTAEETLPIELALEARQQNKYENYSTS FFIRDIIKPDPPKNLQMKPLKNSQVEVSWEYPDSWSTPHSYFSLKFFVRIQRKKEK MKETEEGCNQKGAFLVEKTSTEVQCKGGNVCVQAQDRYYNSSCSKWACVPCRVRSG *GGGSGGGGSGGGGS*RVIPVSGPARCLSQSRNLLKTTDDMVKTAREKLKHYSCTAED IDHEDITRDQTSTLKTCLPLELHKNESCLATRETSSTTRGSCLPPQKTSLMMTLCL GSIYEDLKMYQTEFQAINAALQNHNHQQIILDKGMLVAIDELMQSLNHNGETLRQK PPVGEADPYRVKMKLCILLHAFSTRVVTINRVMGYLSSA<ins>TLVLFGAGFGAVITVVV IVVII</ins>*GKPIPNPLLGLDST*

Italic: signal peptide; Underline: IL12B; Dashed underline and Italic: linker; Bold: IL12A; Double underline: Transmembrane domain; Bold and Italic: V5 tag |

SUMMARY OF SEQUENCES

| SEQ ID NO | Description | Sequence |
|---|---|---|
| 183 | mIL12AB-PTM_v5 miR122 Nucleotide Sequence | ATGTGTCCTCAGAAGCTAACCATCTCCTGGTTTGCCATCGTTTTGCTTGTGTCTCC ACTCATGGCCATGTGGGAGCTCGAGAAAGACGTTTACGTTGTAGAGGTGGACTGGA CTCCCGACGCCCCAGGAGAAACAGTGAACCTCACCTGTGACACGCCTGAAGAAGAT GACATCACCTGGACCTCAGACCAGAGACATGGAGTCATAGGCTCTGGAAAGACCCT GACCATCACTGTCAAAGAGTTCCTAGATGCTGGCCAGTACACCTGCCACAAAGGAG GCGAGACTCTGAGCCACTCACATCTGCTGCTCCACAAGAAGGAGAATGGAATTTGG TCCACCGAAATCCTGAAGAACTTCAAGAATAAGACTTTCCTGAAGTGTGAAGCACC AAATTACTCCGGACGGTTCACGTGCTCATGGCTGGTGCAAAGAAACATGGACTTGA AGTTCAACATCAAGAGCAGTAGCAGTTCCCCTGACTCTCGGGCAGTGACATGTGGA ATGGCGTCTCTGTCTGCAGAGAAGGTCACACTGGACCAAAGGGACTATGAGAAGTA TTCAGTGTCCTGCCAGGAGGATGTCACCTGCCCAACTGCCGAGGAAACTCTGCCCA TTGAACTGGCGTTGGAAGCACGGCAGCAGAATAAATATGAGAACTACAGCACCAGC TTCTTCATCAGGGACATCATCAAACCAGACCCGCCCAAGAACTTGCAGATGAAGCC TTTGAAGAACTCACAGGTGGAGGTCAGCTGGGAGTACCCAGACTCCTGGAGCACTC CCCATTCCTACTTCTCCCTCAAGTTCTTTGTTCGAATCCAGCGCAAGAAAGAGAAG ATGAAGGAGACAGAGGAGGGGTGTAACCAGAAAGGTGCGTTCCTCGTGGAGAAGAC ATCTACCGAAGTCCAATGCAAAGGCGGGAATGTCTGCGTGCAAGCTCAGGATCGCT ATTACAATTCCTCATGCAGCAAGTGGGCATGTGTTCCCTGCAGGGTCCGATCCGGA GGCGGAGGGTCTGGAGGAGGAGGTTCTGGAGGTGGTGGCAGTAGGGTCATTCCAGT CTCTGGACCTGCAAGGTGTCTTAGCCAGTCCCGAAACCTGCTGAAGACCACAGACG ATATGGTGAAGACGGCCAGAGAGAAACTGAAACATTATTCCTGCACAGCAGAGGAC ATCGATCATGAAGATATTACACGGGACCAAACCAGCACATTGAAGACCTGTTTACC ACTGGAACTACACAAGAACGAGAGTTGCCTGGCTACTAGAGAGACTTCTTCCACAA CAAGAGGGAGCTGCCTGCCACCACAGAAGACGTCTTTGATGATGACCCTGTGCCTT GGTAGCATCTACGAGGATCTCAAGATGTACCAGACAGAGTTCCAGGCCATCAACGC AGCACTTCAGAATCACAACCATCAGCAGATCATTTTAGACAAGGGCATGCTGGTGG CCATCGATGAGCTGATGCAATCTCTGAATCATAATGGCGAGACACTTCGCCAGAAA CCTCCTGTGGGAGAAGCAGACCCTTACAGAGTGAAGATGAAGCTCTGCATCCTGCT TCACGCCTTCAGCACCCGCGTCGTCACTATTAACAGGGTGATGGGCTATCTGAGCT CCGCCTCTGGTGGCGGATCAGGCGGCGGCGGCTCTGGCGGCGGTGGAAGCGGAGGT GGCGGGTCTGGCGGAGGTTCACTGCAGGTAGTAGTGATCAGCGCCATCCTGGCCCT GGTGGTGCTGACCGTGATCTCATTGATCATCTTGATTATGCTGTGGGGCGGAGGAG GCAGCGGGAAACCAATTCCAAATCCCCTCCTGGGGTTGGATAGCACC |
| 184 | mIL12AB-PTM_v5 miR122 Amino Acid Sequence | *MCPQKLTISWFAIVLLVSPLM*AMWELEKDVYVVEVDWTPDAPGETVNLTCDTPEED DITWTSDQRHGVIGSGKTLTITVKEFLDAGQYTCHKGGETLSHSHLLLHKKENGIW STEILKNFKNKTFLKCEAPNYSGRFTCSWLVQRNMDLKFNIKSSSSSPDSRAVTCG MASLSAEKVTLDQRDYEKYSVSCQEDVTCPTAEETLPIELALEARQQNKYENYSTS FFIRDIIKPDPPKNLQMKPLKNSQVEVSWEYPDSWSTPHSYFSLKFFVRIQRKKEK MKETEEGCNQKGAFLVEKTSTEVQCKGGNVCVQAQDRYYNSSCSKWACVPCRVRS*G GGGSGGGGSGGGGS*RVIPVSGPARCLSQSRNLLKTTDDMVKTAREKLKHYSCTAED IDHEDITRDQTSTLKTCLPLELHKNESCLATRETSSTTRGSCLPPQKTSLMMTLCL GSIYEDLKMYQTEFQAINAALQNHNHQQIILDKGMLVAIDELMQSLNHNGETLRQK PPVGEADPYRVKMKLCILLHAFSTRVVTINRVMGYLSSA*SGGGSGGGGSGGGGSGG GGSGGGGSL*QVVVISAILALVVLTVISLIILIMLW<u>GGGGS</u>*GKPIPNPLLGLDST* Italic: signal peptide; Underline: IL12B; Dashed underline and Italic: linker; Bold: IL12A; Double underline: Transmembrane domain; Bold and Italic: V5 tag |
| 185 | mIL12AB-8TM_v5_miR122 Nucleotide sequence | ATGTGTCCTCAGAAGCTAACCATCTCCTGGTTTGCCATCGTTTTGTTAGTGTCTCC ACTCATGGCCATGTGGGAGCTCGAGAAAGACGTTTACGTTGTAGAGGTGGACTGGA CTCCCGACGCCCCAGGCGAAACAGTGAACCTCACCTGTGACACGCCTGAAGAAGAT GACATCACCTGGACCTCAGACCAGAGACATGGAGTCTGGAAAGACCCT GACCATCACTGTCAAAGAGTTCCTAGATGCTGGCCAGTACACCTGCCACAAAGGAG GCGAGACTCTGAGCCACTCACATCTGCTGCTCCACAAGAAGGAGAATGGAATTTGG TCCACAGAAATTTTAAAGAACTTCAAGAACAAGACTTTCCTGAAGTGTGAAGCACC AAATTACTCCGGACGGTTCACGTGCTCATGGCTGGTGCAAAGAAACATGGACTTGA AGTTCAACATCAAGAGCAGTAGCAGTTCCCCTGACTCTCGGGCAGTGACATGTGGA ATGGCGTCTCTGTCTGCAGAGAAGGTCACACTGGACCAAAGGGACTATGAGAAGTA TTCAGTGTCCTGCCAGGAGGATGTCACCTGCCCAACTGCCGAGGAGACTCTGCCCA TTGAACTGGCGTTGGAAGCACGGCAGCAGAATAAATATGAGAACTACAGCACCAGC TTCTTCATCAGGGACATCATCAAACCAGACCCGCCCAAGAACTTGCAGATGAAGCC TTTGAAGAACTCACAGGTGGAGGTCAGCTGGGAGTACCCAGACTCCTGGAGCACTC CCCATTCCTACTTCTCCCTCAAGTTCTTTGTTCGAATCCAGCGCAAGAAAGAGAAG |

| SEQ ID NO | Description | Sequence |
|---|---|---|
| | | ATGAAGGAGACAGAGGAGGGGTGTAACCAGAAAGGTGCGTTCCTCGTAGAGAAGAC<br>ATCTACCGAAGTCCAATGCAAAGGCGGGAATGTCTGCGTGCAAGCTCAGGATCGCT<br>ATTACAATTCCTCATGCAGCAAGTGGGCATGTGTTCCCTGCAGGGTCCGATCCGGA<br>GGCGGAGGGAGTGGAGGAGGTGGCTCTGGCGGCGGTGGAAGTAGGGTCATTCCAGT<br>CTCTGGACCTGCACGCTGTCTTAGCCAGTCCCGAAACCTGCTGAAGACCACAGACG<br>ACATGGTGAAGACGGCCAGAGAGAAACTGAAACATTATTCCTGCACAGCGGAAGAC<br>ATAGATCACGAGGATATCACACGGGACCAAACCAGCACATTGAAGACCTGTTTACC<br>ACTGGAACTACACAAGAACGAGAGTTGCCTGGCTACTAGAGAGACTTCTTCCACAA<br>CAAGAGGGAGCTGCCTGCCACCACAGAAGACGTCTTTGATGATGACCCTGTGCCTT<br>GGTAGCATCTATGAGGATCTGAAGATGTACCAGACAGAGTTCCAGGCCATCAACGC<br>AGCACTTCAGAATCACAACCATCAGCAGATCATTTTAGACAAGGGCATGCTGGTGG<br>CCATCGATGAGCTGATGCAGTCCCTGAATCATAATGGTGAAACGTTGCGCCAGAAA<br>CCTCCTGTGGGAGAAGCAGACCCTTACGAGTGAAGATGAAGCTCTGCATCCTGCT<br>TCACGCCTTCAGCACCCGCGTCGTGACTATAAACAGGGTGATGGGCTATCTGAGCT<br>CCGCCTCTGGTGGCGGATCAGGAGGAGGTGGATCCGGTGGCGGTGGTTCCGGAGGT<br>GGTGGATCGGGTGGTGGCTCACTGCAGATCTACATCTGGGCCCCGCTGGCCGGCAT<br>CTGCGTGGCCCTGCTGCTGAGCCTGATCATCACCCTGATCTGCTACGGTGGAGGCG<br>GTAGCGGGAAACCAATTCCAAATCCCCTCCTGGGGTTGGATAGCACC |
| 186 | mIL12AB-<br>8TM_v5_miR<br>122<br>Amino Acid<br>sequence | *MCPQKLTISWFAIVLLVSPLMA*MWELEKDVYVVEVDWTPDAPGETVNLTCDTPEED<br>DITWTSDQRHGVIGSGKTLTITVKEFLDAGQYTCHKGGETLSHSHLLLHKKENGIW<br>STEILKNFKNKTFLKCEAPNYSGRFTCSWLVQRNMDLKFNIKSSSSSPDSRAVTCG<br>MASLSAEKVTLDQRDYEKYSVSCQEDVTCPTAEETLPIELALEARQQNKYENYSTS<br>FFIRDIIKPDPPKNLQMKPLKNSQVEVSWEYPDSWSTPHSYFSLKFFVRIQRKKEK<br>MKETEEGCNQKGAFLVEKTSTEVQCKGGNVCVQAQDRYYNSSCSKWACVPCRVRS*G*<br>*GGGSGGGGSGGGGS*RVIPVSGPARCLSQSRNLLKTTDDMVKTAREKLKHYSCTAED<br>IDHEDITRDQTSTLKTCLPLELHKNESCLATRETSSTTRGSCLPPQKTSLMMTLCL<br>GSIYEDLKMYQTEFQAINAALQNHNHQQIILDKGMLVAIDELMQSLNHNGETLRQK<br>PPVGEADPYRVKMKLCILLHAFSTRVVTINRVMGYLSSA*SGGGSGGGGSGGGGSGG*<br>*GGSGGGSL*<u>QIYIWAPLAGICVALLLSLIITLICY</u>*GGGGS**GKPIPNPLLGLDST*<br><br>Italic: signal peptide; Underline: IL12B; Dashed<br>underline and Italic: linker; Bold: IL12A; Double<br>underline: Transmembrane domain; Bold and Italic: V5 tag |
| 187 | XbaI restriction site | TCTAGA |
| 188 | EcoRI | GAATTC |
| 189 | EcoRII | CCWGG (W = A or T) |
| 190 | HindIII | AAGCTT |
| 191 | T7 RNA polymerase | GnnnnWnCRnCTCnCnnWnD<br>(n = any nucleotide; R = A or G; W = A or T;<br>D = A or G or T but not C) |
| 192 | Linker (amino acid sequence) | GGGGG |
| 193 | Gly/ser linker (amino acid sequence) | $(G_nS)_m$ n = 1-100; m = 1-100 |
| 194 | Gly/ser linker (amino acid sequence) | $(GGGGS)_o$ o = 1-5 |
| 195 | Gly/ser linker (amino acid sequence) | GGSGGGGSGG |

SUMMARY OF SEQUENCES

| SEQ ID NO | Description | Sequence |
|---|---|---|
| 196 | Gly/ser linker (amino acid sequence) | GGSGGGGG |
| 197 | Gly/ser linker (amino acid sequence) | GSGSGSGS |
| 198 | Gly-rich linker (amino acid sequence) | $(Gly)_p$ p = 1-100 |
| 199 | Linker (amino acid sequence) | $(EAAAK)_q$ q = 1-100 |
| 200 | Linker (amino acid sequence) | GGGGSLVPRGSGGGGS |
| 201 | Linker (amino acid sequence) | GSGSGS |
| 202 | Linker (amino acid sequence) | GGGGSLVPRGSGGGG |
| 203 | Linker (amino acid sequence) | GGSGGHMGSGG |
| 204 | Linker (amino acid sequence) | GGSGGSGGSGG |
| 205 | Linker (amino acid sequence) | GGSGG |
| 206 | Linker (amino acid sequence) | GSGSGSGS |
| 207 | Linker (amino acid sequence) | GGGSEGGGSEGGGSEGGG |
| 208 | Linker (amino acid sequence) | AAGAATAA |
| 209 | Linker (amino acid sequence) | GGSSG |
| 210 | Linker (amino acid sequence) | GSGGGTGGGSG |
| 211 | Linker (amino acid sequence) | GSGSGSGSGGSG |
| 212 | Linker (amino acid sequence) | GSGGSGSGGSGGSG |
| 213 | Linker (amino acid sequence) | GSGGSGGSGGSGGS |
| 214 | Linker (amino acid sequence) | GGGGGGS |
| 215 | Polynucleotide | ATCCCG |
| 216 | Kozak consensus sequence | CCR(A/G)CCAUGG R = purine |
| 217 | Linker (amino acid sequence) | GGGGGG |
| 218 | Linker (amino acid sequence) | GGGGGGG |

| SEQ ID NO | Description | Sequence |
|---|---|---|
| 219 | Linker (amino acid sequence) | GGGGGGGG |
| 220 | hIL12AB_041 ORF | ATGTGCCACCAGCAGCTGGTGATCAGCTGGTTCAGCCTGGTGTTCCTGGCCAGCCC<br>CCTGGTGGCCATCTGGGAGCTGAAGAAGGACGTGTACGTGGTGGAGTTGGATTGGT<br>ACCCCGACGCCCCCGGCGAGATGGTGGTGCTGACCTGCGACACCCCCGAGGAGGAC<br>GGCATCACCTGGACCCTGGACCAGAGCAGCGAGGTGCTGGGCAGCGGCAAGACCCT<br>GACCATCCAGGTGAAGGAGTTCGGCGACGCCGGCCAGTACACCTGCCACAAGGGCG<br>GCGAGGTGCTGAGCCACAGCCTGCTGCTGCTGCACAAGAAGGAGGACGGCATCTGG<br>AGCACCGACATCCTGAAGGACCAGAAGGAGCCCAAGAACAAGACCTTCCTGAGATG<br>CGAGGCCAAGAACTACAGCGGCAGATTCACCTGCTGGTGGCTGACCACCATCAGCA<br>CCGACCTGACCTTCAGCGTGAAGAGCAGCAGAGGCAGCAGCGACCCCCAGGGCGTG<br>ACCTGCGGCGCCGCCACCCTGAGCGCCGAGAGAGTGAGAGGCGACAACAAGGAGTA<br>CGAGTACAGCGTGGAGTGCCAGGAAGATAGCGCCTGCCCCGCCGCCGAGGAGAGCC<br>TGCCCATCGAGGTGATGGTGGACGCCGTGCACAAGCTGAAGTACGAGAACTACACC<br>AGCAGCTTCTTCATCAGAGATATCATCAAGCCCGACCCCCCAAGAACCTGCAGCT<br>GAAGCCCCTGAAGAACAGCCGGCAGGTGGAGGTGAGCTGGGAGTACCCCGACACCT<br>GGAGCACCCCCCACAGCTACTTCAGCCTGACCTTCTGCGTGCAGGTGCAGGGCAAG<br>AGCAAGAGAGAAGAAAGATAGAGTGTTCACCGACAAGACCAGCGCCACCGTGAT<br>CTGCAGAAAGAACGCCAGCATCAGCGTGAGAGCCCAAGATAGATACTACAGCAGCA<br>GCTGGAGCGAGTGGGCCAGCGTGCCCTGCAGCGGCGGCGGCGGCGGCGGCAGCAGA<br>AACCTGCCCGTGGCCACCCCCGACCCCGGCATGTTCCCCTGCCTGCACCACAGCCA<br>GAACCTGCTGAGAGCCGTGAGCAACATGCTGCAGAAGGCCCGGCAGACCCTGGAGT<br>TCTACCCCTGCACCAGCGAGGAGATCGACCACGAAGATATCACCAAAGATAAGACC<br>AGCACCGTGGAGGCCTGCCTGCCCCTGGAGCTGACCAAGAACGAGAGCTGCCTGAA<br>CAGCAGAGAGACCAGCTTCATCACCAACGGCAGCTGCCTGGCCAGCAGAAAGACCA<br>GCTTCATGATGGCCCTGTGCCTGAGCAGCATCTACGAGGACCTGAAGATGTACCAG<br>GTGGAGTTCAAGACCATGAACGCCAAGCTGCTGATGGACCCCAAGCGGCAGATCTT<br>CCTGGACCAGAACATGCTGGCCGTGATCGACGAGCTGATGCAGGCCCTGAACTTCA<br>ACAGCGAGACCGTGCCCCAGAAGAGCAGCCTGGAGGAGCCCGACTTCTACAAGACC<br>AAGATCAAGCTGTGCATCCTGCTGCACGCCTTCAGAATCAGAGCCGTGACCATCGA<br>CAGAGTGATGAGCTACCTGAACGCCAGC |
| 221 | hIL12AB_041 mRNA ORF | AUGUGCCACCAGCAGCUGGUGAUCAGCUGGUUCAGCCUGGUGUUCCUGGCCAGCCC<br>CCUGGUGGCCAUCUGGGAGCUGAAGAAGGACGUGUACGUGGUGGAGUUGGAUUGGU<br>ACCCCGACGCCCCCGGCGAGAUGGUGGUGCUGACCUGCGACACCCCCGAGGAGGAC<br>GGCAUCACCUGGACCCUGGACCAGAGCAGCGAGGUGCUGGGCAGCGGCAAGACCCU<br>GACCAUCCAGGUGAAGGAGUUCGGCGACGCCGGCCAGUACACCUGCCACAAGGGCG<br>GCGAGGUGCUGAGCCACAGCCUGCUGCUGCUGCACAAGAAGGAGGACGGCAUCUGG<br>AGCACCGACAUCCUGAAGGACCAGAAGGAGCCCAAGAACAAGACCUUCCUGAGAUG<br>CGAGGCCAAGAACUACAGCGGCAGAUUCACCUGCUGGUGGCUGACCACCAUCAGCA<br>CCGACCUGACCUUCAGCGUGAAGAGCAGCAGAGGCAGCAGCGACCCCCAGGGCGUG<br>ACCUGCGGCGCCGCCACCCUGAGCGCCGAGAGAGUGAGAGGCGACAACAAGGAGUA<br>CGAGUACAGCGUGGAGUGCCAGGAAGAUAGCGCCUGCCCCGCCGCCGAGGAGAGCC<br>UGCCCAUCGAGGUGAUGGUGGACGCCGUGCACAAGCUGAAGUACGAGAACUACACC<br>AGCAGCUUCUUCAUCAGAGAUAUCAUCAAGCCCGACCCCCCAAGAACCUGCAGCU<br>GAAGCCCCUGAAGAACAGCCGGCAGGUGGAGGUGAGCUGGGAGUACCCCGACACCU<br>GGAGCACCCCCCACAGCUACUUCAGCCUGACCUUCUGCGUGCAGGUGCAGGGCAAG<br>AGCAAGAGAGAAGAAAGAUAGAGUGUUCACCGACAAGACCAGCGCCACCGUGAU<br>CUGCAGAAAGAACGCCAGCAUCAGCGUGAGAGCCCAAGAUAGAUACUACAGCAGCA<br>GCUGGAGCGAGUGGGCCAGCGUGCCCUGCAGCGGCGGCGGCGGCGGCGGCAGCAGA<br>AACCUGCCCGUGGCCACCCCCGACCCCGGCAUGUUCCCCUGCCUGCACCACAGCCA<br>GAACCUGCUGAGAGCCGUGAGCAACAUGCUGCAGAAGGCCCGGCAGACCCUGGAGU<br>UCUACCCCUGCACCAGCGAGGAGAUCGACCACGAAGAUAUCACCAAAGAUAAGACC<br>AGCACCGUGGAGGCCUGCCUGCCCCUGGAGCUGACCAAGAACGAGAGCUGCCUGAA<br>CAGCAGAGAGACCAGCUUCAUCACCAACGGCAGCUGCCUGGCCAGCAGAAAGACCA<br>GCUUCAUGAUGGCCCUGUGCCUGAGCAGCAUCUACGAGGACCUGAAGAUGUACCAG<br>GUGGAGUUCAAGACCAUGAACGCCAAGCUGCUGAUGGACCCCAAGCGGCAGAUCUU<br>CCUGGACCAGAACAUGCUGGCCGUGAUCGACGAGCUGAUGCAGGCCCUGAACUUCA<br>ACAGCGAGACCGUGCCCCAGAAGAGCAGCCUGGAGGAGCCCGACUUCUACAAGACC<br>AAGAUCAAGCUGUGCAUCCUGCUGCACGCCUUCAGAAUCAGAGCCGUGACCAUCGA<br>CAGAGUGAUGAGCUACCUGAACGCCAGC |
| 222 | 3UTR-018 + miR-122-5p binding site | UAAUAGGCUGGAGCCUCGGUGGCCAUGCUUCUUGCCCCUUGGGCCUCCCCCCAGCC<br>CCUCCUCCCCUUCCUGCACCCGUACCCCCCAAACACCAUUGUCACACUCCAGUGGU<br>CUUUGAAUAAAGUCUGAGUGGGCGGC |

SUMMARY OF SEQUENCES

| SEQ ID NO | Description | Sequence |
|---|---|---|
| 223 | 3UTR-018 + miR-122-3p binding site | UAAUAGGCUGGAGCCUCGGUGGCCAUGCUUCUUGCCCCUUGGGCCCUCCCCCCAGCC CCUCCUCCCCUUCCUGCACCCGUACCCCC<u>UAUUUAGUGUGAUAAUGGCGUU</u>GUGGU CUUUGAAUAAAGUCUGAGUGGGCGGC |
| 224 | 3UTR-019 + miR-122 binding site | UGAUAAUAGGCUGGAGCCUCGGUGGCCAUGCUUCUUGCCCCUUGGGCCCUCCCCCCA GCCCCUCCUCCCCUUCCUGCACCCGUACCCCC<u>CAAACACCAUUGUCACACUCCA</u>GU GGUCUUUGAAUAAAGUCUGAGUGGGCGGC |
| 225 | Human CD80 Intracellular Domain | TYCFAPRCRERRRNERLRRESVRPV |
| 226 | Human PGFRB Intracellular Domain (WT) | QKKPRYEIRWKVIESVSSDGHEYIYVDPMQLPYDSTWELPRDQLVLGRTLGSGAFG QVVEATAHGLSHSQATMKVAVKMLKSTARSSEKQALMSELKIMSHLGPHLNVVNLL GACTKGGPIYIITEYCRYGDLVDYLHRNKHTFLQHHSDKRRPPSAELYSNALPVGL PLPSHVSLTGESDGGYMDMSKDESVDYVPMLDMKGDVKYADIESSNYMAPYDNYVP SAPERTCRATLINESPVLSYMDLVGFSYQVANGMEFLASKNCVHRDLAARNVLICE GKLVKICDFGLARDIMRDSNYISKGSTFLPLKWMAPESIFNSLYTTLSDVWSFGIL LWEIFTLGGTPYPELPMNEQFYNAIKRGYRMAQPAHASDEIYEIMQKCWEEKFEIR PPFSQLVLLLERLLGEGYKKKYQQVDEEFLRSDHPAILRSQARLPGFHGLRSPLDT SSVLYTAVQPNEGDNDYIIPLPDPKPEVADEGPLEGSPSLASSTLNEVNTSSTISC DSPLEPQDEPEPEPQLELQVEPEPELEQLPDSGCPAPRAEAEDSFL |
| 227 | Human PGFRB Intracellular Domain (E570tr) | QKKPRYEIRWKVIESVSSDGHE |
| 228 | Human PGFRB Intracellular Domain (G739tr) | QKKPRYEIRWKVIESVSSDGHEFIFVDPMQLPYDSTWELPRDQLVLGRTLGSGAFG QVVEATAHGLSHSQATMKVAVKMLKSTARSSEKQALMSELKIMSHLGPHLNVVNLL GACTKGGPIYIITEYCRYGDLVDYLHRNKHTFLQHHSDKRRPPSAELYSNALPVGL PLPSHVSLTGESDGG |
| 229 | Linker | SGGGSGGGGSGGGGSGGGGSGGGSLQ |
| 230 | V5 tag | GKPIPNPLLGLDST |
| 231 | G4S Linker | GGGGS |
| 232 | Murine CD8 Transmembrane Domain | IYIWAPLAGICVALLLSLIITLI |
| 233 | Murine PDGFR Transmembrane domain | VVVISAILALVVLTVISLIILIMLW |
| 234 | Murine CD80 Transmembrane domain | TLVLFGAGFGAVITVVVIVVII |
| 235 | Murine CD80 intracellular domain | KCFCKHRSCFRRNEASRETNNSLTFGPEEALA |
| 236 | mIL12AB-80TM-ICD Nucleotide Sequence | ATGTGTCCTCAGAAGCTAACCATCTCCTGGTTTGCCATCGTTTTGTTGGTGTCTCC ACTCATGGCCATGTGGGAGCTCGAGAAAGACGTTTACGTTGTAGAGGTGGACTGGA CTCCCGACGCCCCGGGCGAAACAGTGAACCTCACCTGTGACACGCCTGAAGAAGAT GACATCACCTGGACCTCAGACCAGAGACATGGAGTCATAGGCTCTGGAAAGACCCT GACCATCACTGTCAAAGAGTTCCTAGATGCTGGCCAGTACACCTGCCACAAAGGAG GCGAGACTCTGAGCCACTCACATCTGCTGCTCCACAAGAAGGAGAATGGAATTTGG TCCACTGAGATCCTGAAGAACTTCAAGAATAAGACTTTCCTGAAGTGTGAAGCACC AAATTACTCCGGACGGTTCACGTGCTCATGGCTGGTGCAAAGAAACATGGACTTGA AGTTCAACATCAAGAGCAGTAGCAGTTCCCCTGACTCTCGGGCAGTGACATGTGGA ATGGCGTCTCTGTCTGCAGAGAAGGTCACACTGGACCAAAGGGACTATGAGAAGTA TTCAGTGTCCTGCCAGGAGGATGTCACCTGCCCAACTGCCGAGGAGACACTGCCCA TTGAACTGGCGTTGGAAGCACGGCAGCAGAATAAATATGAGAACTACAGCACCAGC TTCTTCATCAGGGACATCATCAAACCAGACCCGCCCAAGAACTTGCAGATGAAGCC |

| SEQ ID NO | Description | Sequence |
|---|---|---|
| | | TTTGAAGAACTCACAGGTGGAGGTCAGCTGGGAGTACCCGGACTCCTGGAGCACTC CCCATTCCTACTTCTCCCTCAAGTTCTTTGTTCGAATCCAGCGCAAGAAAGAGAAG ATGAAGGAGACAGAGGAGGGGTGTAACCAGAAAGGTGCGTTCCTCGTAGAGAAGAC ATCTACCGAAGTCCAATGCAAAGGCGGGAATGTCTGCGTGCAAGCTCAGGATCGCT ATTACAATTCCTCATGCAGCAAGTGGGCATGTGTTCCCTGCAGGGTCCGATCCGGA GGCGGAGGGAGCGGTGGTGGAGGCAGCGGAGGAGGTGGATCAAGGGTCATTCCAGT CTCTGGACCAGCTAGATGTCTTAGCCAGTCCCGAAACCTGCTGAAGACCACGGACG ACATGGTGAAGACGGCCAGAGAGAAACTGAAACATTATTCCTGCACCGCAGAGGAT ATCGATCACGAAGATATCACACGGGACCAAACCAGCACATTGAAGACCTGTTTACC ACTGGAACTACACAAGAACGAGAGTTGCCTGGCTACTAGAGAGACTTCTTCCACAA CAAGAGGGAGCTGCCTGCCACCACAGAAGACGTCTTTGATGATGACCCTGTGCCTT GGTAGCATCTATGAGGACCTCAAGATGTACCAGACAGAGTTCCAGGCCATCAACGC AGCACTTCAGAATCACAACCATCAGCAGATCATTTTAGACAAGGGCATGCTGGTGG CCATCGATGAGCTGATGCAATCATTGAATCATAACGGTGAGACATTGCGCCAGAAA CCTCCTGTGGGAGAAGCAGACCCTTACAGAGTGAAGATGAAGCTCTGCATCCTGCT TCACGCCTTCAGCACCCGTCGTCACTATCAACAGGGTGATGGGCTATCTGAGCT CCGCCAGCGGTGGCGGAAGCGGTGGAGGCGGCAGCGGCGGTGGTGGTAGCGGCGGC GGCGGCTCCGGCGAGGGAGCCTGCAGACCCTGGTGCTGTTCGGCGCCGGCTTCGG TGCAGTGATCACCGTGGTGGTGATCGTCGTCATCATCAAGTGCTTCTGCAAGCACA GAAGCTGCTTCAGAAGAAACGAGGCCAGCAGAGAAACCAACAACAGCCTAACATTC GGCCCAGAAGAGGCTCTGGCC |
| 237 | mIL12AB-80TM-ICD Amino Acid Sequence | *MCPQKLTISWFAIVLLVSPLMA*MWELEKDVYVVEVDWTPDAPGETVNLTCDTPEED DITWTSDQRHGVIGSGKTLTITVKEFLDAGQYTCHKGGETLSHSHLLLHKKENGIW STEILKNFKNKTFLKCEAPNYSGRFTCSWLVQRNMDLKFNIKSSSSSPDSRAVTCG MASLSAEKVTLDQRDYEKYSVSCQEDVTCPTAEETLPIELALEARQQNKYENYSTS FFIRDIIKPDPPKNLQMKPLKNSQVEVSWEYPDSWSTPHSYFSLKFFVRIQRKKEK MKETEEGCNQKGAFLVEKTSTEVQCKGGNVCVQAQDRYYNSSCSKWACVPCRVRS*G GGGSGGGGSGGGGS*RVIPVSGPARCLSQSRNLLKTTDDMVKTAREKLKHYSCTAED IDHEDITRDQTSTLKTCLPLELHKNESCLATRETSSTTRGSCLPPQKTSLMMTLCL GSIYEDLKMYQTEFQAINAALQNHNHQQIILDKGMLVAIDELMQSLNHNGETLRQK PPVGEADPYRVKMKLCILLHAFSTRVVTINRVMGYLSSA*SGGGSGGGGSGGGGSGG GGSGGGSL*QTLVLFGAGFGAVITVVVIVVII*KCFCKHRSCFRRNEASRETNNSLTF GPEEALA*

Italic: signal peptide; Underline: IL12B; Dashed underline and Italic: linker; Bold: IL12A; Double underline: Transmembrane domain; Bold and Italic: Intracellular domain |
| 238 | IgK-mscIL12AB-80TM-ICD Nucleotide Sequence | ATGGAGACTGACACCCTGCTGCTGTGGGTGCTGTTACTTTGGGTTCCCGGCAGCAC CGGCTACCCCTACGACGTGCCCGACTACGCCATGTGGGAGCTCGAGAAAGACGTTT ACGTTGTAGAGGTGGACTGGACTCCCGACGCCCCGGGCGAAACAGTGAACCTCACC TGTGACACGCCTGAAGAAGATGACATCACCTGGACCTCAGACCAGAGACATGGAGT CATAGGCTCTGGAAAGACCCTGACCATCACTGTCAAAGAGTTCCTAGATGCTGGCC AGTACACCTGCCACAAAGGAGGCGAGACTCTGAGCCACTCACATCTGCTGCTCCAC AAGAAGGAGAATGGAATTTGGTCCACTGAGATCCTGAAGAACTTCAAGAATAAGAC TTTCCTGAAGTGTGAAGCACCCAATTACTCCGGACGGTTCACGTGCTCATGGCTGG TGCAAAGAAACATGGACTTGAAGTTCAACATCAAGAGCAGTAGCAGTTCCCCTGAC TCTCGGGCAGTGACATGTGGAATGGCGTCTCTGTCTGCAGAGAAGGTCACACTGGA CCAAAGGGACTATGAGAAGTATTCAGTGTCCTGCCAGGAGGATGTCACCTGCCCAA CTGCCGAGGAGACACTGCCCATTGAACTGGCGTTGGAAGCACGGCAGCAGAATAAA TATGAGAACTACAGCACCAGCTTCTTCATCAGGGACATCATCAAACCAGACCCGCC CAAGAACTTGCAGATGAAGCCTTTGAAGAACTCACAGGTGGAGGTCAGCTGGGAGT ACCCGGACTCCTGGAGCACTCCCCATTCCTACTTCTCCCTCAAGTTCTTTGTTCGA ATCCAGCGCAAGAAGAGAAGATGAAGGAGACAGAGGAGGGTGTAACCAGAAAGG TGCGTTCCTCGTAGAGAAGACATCTACCGAAGTCCAATGCAAAGGCGGGAATGTCT GCGTGCAAGCTCAGGATCGCTATTACAATTCCTCATGCAGCAAGTGGGCATGTGTT CCCTGCAGGGTCCGAGGAAGCACCAGCGGTTCCGGCAAACCAGGTAGCGGAGAGGG CAGCACCAAGGGCAGGGTCATTCCAGTCTCTGGACCAGCTAGATGTCTTAGCCAGT CCCGAAACCTGCTGAAGACCACGGACGACATGGTGAAGACGGCCAGAGAGAAACTG AAACATTATTCCTGCACCGCAGAGGATATCGATCACGAAGATATCACACGGGACCA AACCAGCACATTGAAGACCTGTTTACCACTGGAACTACACAAGAACGAGAGTTGCC TGGCTACTAGAGAGACTTCTTCCACAACAAGAGGGAGCTGCCTGCCACCACAGAAG |

| SEQ ID NO | Description | Sequence |
|---|---|---|
| | | ACGTCTTTGATGATGACCCTGTGCCTTGGTAGCATCTATGAGGACCTCAAGATGTA<br>CCAGACAGAGTTCCAGGCCATCAACGCAGCACTTCAGAATCACAACCATCAGCAGA<br>TCATTTTAGACAAGGGCATGCTGGTGGCCATCGATGAGCTGATGCAATCATTGAAT<br>CATAACGGTGAGACATTGCGCCAGAAACCTCCTGTGGGAGAAGCAGACCCTTACAG<br>AGTGAAGATGAAGCTCTGCATCCTGCTTCACGCCTTCAGCACCCGCGTCGTCACTA<br>TCAACAGGGTGATGGGCTATCTGAGCTCCGCCACCCTGGTGCTGTTCGGCGCCGGC<br>TTCGGTGCAGTGATCACCGTGGTGGTGATCGTCGTCATCATCAAGTGCTTTTGCAA<br>GCACAGAAGCTGTTTCAGAAGAAACGAGGCCAGCAGAGAAACCAACAACTCCCTGA<br>CTTTCGGGCCCGAGGAAGCCCTCGCC |
| 239 | IgK-<br>mscIL12AB-<br>80TM-ICD<br>Amino Acid<br>Sequence | *METDTLLLWVLLLWVPGSTG*YPYDVPDYAM<u>WELEKDVYVVEVDWTPDAPGETVNLT<br>CDTPEEDDITWTSDQRHGVIGSGKTLTITVKEFLDAGQYTCHKGGETLSHSHLLLH<br>KKENGIWSTEILKNFKNKTFLKCEAPNYSGRFTCSWLVQRNMDLKFNIKSSSSSPD<br>SRAVTCGMASLSAEKVTLDQRDYEKYSVSCQEDVTCPTAEETLPIELALEARQQNK<br>YENYSTSFFIRDIIKPDPPKNLQMKPLKNSQVEVSWEYPDSWSTPHSYFSLKFFVR<br>IQRKKEKMKETEEGCNQKGAFLVEKTSTEVQCKGGNVCVQAQDRYYNSSCSKWACV<br>PCRVR</u>*GSTSGSGKPGSGEGSTKG*RVIPVSGPARCLSQSRNLLKTTDDMVKTAREKL<br>KHYSCTAEDIDHEDITRDQTSTLKTCLPLELHKNESCLATRETSSTTRGSCLPPQK<br>TSLMMTLCLGSIYEDLKMYQTEFQAINAALQNHNHQQIILDKGMLVAIDELMQSLN<br>HNGETLRQKPPVGEADPYRVKMKLCILLHAFSTRVVTINRVMGYLSSA<u><u>TLVLFGAG<br>FGAVITVVVIVVII</u></u>*KCFCKHRSCFRRNEASRETNNSLTFGPEEALA*<br><br>Italic: signal peptide; Underline: IL12B; Dashed<br>underline and Italic: linker; Bold: IL12A; Double<br>underline: Transmembrane domain; Bold and Italic:<br>Intracellular domain; Bold underline: epitope tag |
| 240 | hIL12AB-<br>8TM<br>Nucleotide<br>Sequence | ATGTGCCACCAGCAGCTGGTGATCAGCTGGTTCAGCCTGGTGTTCCTGGCCAGCCC<br>CCTGGTGGCCATCTGGGAGCTGAAGAAGGACGTGTACGTGGTGGAGTTGGATTGGT<br>ACCCCGACGCCCCCGGCGAGATGGTGGTGCTGACCTGCGACACCCCCGAGGAGGAC<br>GGCATCACCTGGACCCTGGACCAGAGCAGCGAGGTGCTGGGCAGCGGCAAGACCCT<br>GACCATCCAGGTGAAGGAGTTCCGGGACGCCGGCCAGTACACCTGCCACAAGGGCG<br>GCGAGGTGCTGAGCCACAGCCTGCTGCTGCTGCACAAGAAGGAGGACGGCATCTGG<br>AGCACCGACATCCTGAAGGACCAGAAGGAGCCCAAGAACAAGACCTTCCTGAGATG<br>CGAGGCCAAGAACTACAGCGGCAGATTCACCTGCTGGTGGCTGACCACCATCAGCA<br>CCGACCTGACCTTCAGCGTGAAGAGCAGCAGAGGCAGCAGCGACCCCCAGGGCGTG<br>ACCTGCGGCGCCGCCACCCTGAGCGCCGAGAGTGAGAGGCGACAACAAGGAGTA<br>CGAGTACAGCGTGGAGTGCCAGGAAGATAGCGCCTGCCCCGCCGCCGAGGAGAGCC<br>TGCCCATCGAGGTGATGGTGGACGCCGTGCACAAGCTGAAGTACAGAGAACTACACC<br>AGCAGCTTCTTCATCAGAGATATCATCAAGCCCGACCCCCCCAAGAACCTGCAGCT<br>GAAGCCCCTGAAGAACAGCCGGCAGGTGGAGGTGAGCTGGGAGTACCCCGACACCT<br>GGAGCACCCCCCACAGCTACTTCAGCCTGACCTTCTGCGTGCAGGTGCAGGGCAAG<br>AGCAAGAGAGAAGAAAGATAGAGTGTTCACCGACAAGACCAGCGCCACCGTGAT<br>CTGCAGAAAGAACGCCAGCATCAGCGTGAGAGCCCAAGATAGATACTACAGCAGCA<br>GCTGGAGCGAGTGGGCCAGCGTGCCCTGCAGCGGCGGCGGCGGCGGCAGCAGA<br>AACCTGCCCGTGGCCACCCCCGACCCCGGCATGTTCCCCTGCCTGCACCACAGCCA<br>GAACCTGCTGAGAGCCGTGAGCAACATGCTGCAGAAGGCCCGGCAGACCCTGGAGT<br>CTACCCCTGCACCAGCGAGGAGATCGACCACGAAGATATCACCAAAGATAAGACC<br>AGCACCGTGGAGGCCTGCCTGCCCCTGGAGCTGACCAAGAACGAGAGCTGCCTGAA<br>CAGCAGAGAGACCAGCTTCATCACCAACGGCAGCTGCCTGGCCAGCAGAAAGACCA<br>GCTTCATGATGGCCCTGTGCCTGAGCAGCATCTACGAGGACCTGAAGATGTACCAG<br>GTGGAGTTCAAGACCATGAACGCCAAGCTGCTGATGGACCCCAAGCGGCAGATCTT<br>CCTGGACCAGAACATGCTGGCCGTGATCGACGAGCTGATGCAGGCCCTGAACTTCA<br>ACAGCGAGACCGTGCCCCAGAAGAGCAGCCTGGAGGAGCCCGACTTCTACAAGACC<br>AAGATCAAGCTGTGCATCCTGCTGCACGCCTTCAGAATCAGAGCCGTGACCATCGA<br>CAGAGTGATGAGCTACCTGAACGCCAGCTCTGGTGGCGGATCAGGCGGCGGCGGTT<br>CAGGAGGCGGTGGAAGTGGAGGTGGCGGGTCGGCGGAGGTTCACTGCAGATCTAC<br>ATCTGGGCTCCACTGGCCGGCACCCTGCGCGCGTGCTGCTGCTGAGCCTGGTGATCAC<br>CCTGTACTGCTACGGGAAACCAATTCCAAATCCCCTCCTGGGGTTGGATAGCACC |

| SEQ ID NO | Description | Sequence |
|---|---|---|
| 241 | hIL12AB-8TM Amino Acid Sequence | *MCHQQLVISWFSLVFLASPLVAI*WELKKDVYVVELDWYPDAPGEMVVLTCDTPEED GITWTLDQSSEVLGSGKTLTIQVKEFGDAGQYTCHKGGEVLSHSLLLLHKKEDGIW STDILKDQKEPKNKTFLRCEAKNYSGRFTCWWLTTISTDLTFSVKSSRGSSDPQGV TCGAATLSAERVRGDNKEYEYSVECQEDSACPAAEESLPIEVMVDAVHKLKYENYT SSFFIRDIIKPDPPKNLQLKPLKNSRQVEVSWEYPDTWSTPHSYFSLTFCVQVQGK SKREKKDRVFTDKTSATVICRKNASISVRAQDRYYSSSWSEWASVPCS*GGGGGGS*R NLPVATPDPGMFPCLHHSQNLLRAVSNMLQKARQTLEFYPCTSEEIDHEDITKDKT STVEACLPLELTKNESCLNSRETSFITNGSCLASRKTSFMMALCLSSIYEDLKMYQ VEFKTMNAKLLMDPKRQIFLDQNMLAVIDELMQALNFNSETVPQKSSLEEPDFYKT KIKLCILLHAFRIRAVTIDRVMSYLNAS*SGGGSGGGGSGGGGSGGGGSGGGSL*QIY IWAPLAGTCGVLLLSLVITLYCYGKPIPNPLLGLDST* Italic: signal peptide; Underline: IL12B; Dashed underline and Italic: linker; Bold: IL12A; Double underline: Transmembrane domain; Bold and Italic: Epitope tag |
| 242 | hIL12AB-8TM no epitope tag Nucleotide Sequence | ATGTGCCACCAGCAGCTGGTGATCAGCTGGTTCAGCCTGGTGTTCCTGGCCAGCCC CCTGGTGGCCATCTGGGAGCTGAAGAAGGACGTGTACGTGGTGGAGTTGGATTGGT ACCCCGACGCCCCCGGCGAGATGGTGGTGCTGACCTGCGACACCCCCGAGGAGGAC GGCATCACCTGGACCCTGGACCAGAGCAGCGAGGTGCTGGGCAGCGGCAAGACCCT GACCATCCAGGTGAAGGAGTTCGGCGACGCCGGCCAGTACACCTGCCACAAGGGCG GCGAGGTGCTGAGCCACAGCCTGCTGCTGCTGCACAAGAAGGAGGACGGCATCTGG AGCACCGACATCCTGAAGGACCAGAAGGAGCCCAAGAACAAGACCTTCCTGAGATG CGAGGCCAAGAACTACAGCGGCAGATTCACCTGCTGGTGGCTGACCACCATCAGCA CCGACCTGACCTTCAGCGTGAAGAGCAGCAGAGGCAGCAGCGACCCCCAGGGCGTG ACCTGCGGCGCCGCCACCCTGAGCGCCGAGAGAGTGAGAGGCGACAACAAGGAGTA CGAGTACAGCGTGGAGTGCCAGGAAGATAGCGCCTGCCCCGCCGCCGAGGAGAGCC TGCCCATCGAGGTGATGGTGGACGCCGTGCACAAGCTGAAGTACGAGAACTACACC AGCAGCTTCTTCATCAGAGATATCATCAAGCCCGACCCCCCCAAGAACCTGCAGCT GAAGCCCCTGAAGAACAGCCGGCAGGTGGAGGTGAGCTGGGAGTACCCCGACACCT GGAGCACCCCCCACAGCTACTTCAGCCTGACCTTCTGCGTGCAGGTGCAGGGCAAG AGCAAGAGAGAAGAAAGATAGAGTGTTCACCGACAAGACCAGCGCCACCGTGAT CTGCAGAAAGAACGCCAGCATCAGCGTGAGAGCCCAAGATAGATACTACAGCAGCA GCTGGAGCGAGTGGGCCAGCGTGCCCTGCAGCGGCGGCGGCGGCGGCAGCAGA AACCTGCCCGTGGCCACCCCCGACCCCGGCATGTTCCCCTGCCTGCACCACAGCCA GAACCTGCTGAGAGCCGTGAGCAACATGCTGCAGAAGGCCCGGCAGACCCTGGAGT TCTACCCCTGCACCAGCGAGGAGATCGACCACGAAGATATCACCAAAGATAAGACC AGCACCGTGGAGGCCTGCCTGCCCCTGGAGCTGACCAAGAACGAGAGCTGCCTGAA CAGCAGAGAGACCAGCTTCATCACCAACGGCAGCTGCCTGGCCAGCAGAAAGACCA GCTTCATGATGGCCCTGTGCCTGAGCAGCATCTACGAGGACCTGAAGATGTACCAG GTGGAGTTCAAGACCATGAACGCCAAGCTGCTGATGGACCCCAAGCGGCAGATCTT CCTGGACCAGAACATGCTGGCCGTGATCGACGAGCTGATGCAGGCCCTGAACTTCA ACAGCGAGACCGTGCCCCAGAAGAGCAGCCTGGAGGAGCCCGACTTCTACAAGACC AAGATCAAGCTGTGCATCCTGCTGCACGCCTTCAGAATCAGAGCCGTGACCATCGA CAGAGTGATGAGCTACCTGAACGCCAGCTCTGGTGGCGGATCAGGCGGCGGCGGTT CAGGAGGCGGTGGAAGTGGAGGTGGCGGGTCGGCGGAGGTTCACTGCAGATCTAC ATCTGGGCTCCACTGGCCGGCACCTGCGGCGTGCTGCTGCTGAGCCTGGTGATCAC CCTGTACTGCTAC |

US 11,421,011 B2

-continued

SUMMARY OF SEQUENCES

| SEQ ID NO | Description | Sequence |
|---|---|---|
| 243 | hIL12AB-8TM no epitope tag Amino Acid Sequence | *MCHQQLVISWFSLVFLASPLVAI*WELKKDVYVVELDWYPDAPGEMVVLTCDTPEED GITWTLDQSSEVLGSGKTLTIQVKEFGDAGQYTCHKGGEVLSHSLLLLHKKEDGIW STDILKDQKEPKNKTFLRCEAKNYSGRFTCWWLTTISTDLTFSVKSSRGSSDPQGV TCGAATLSAERVRGDNKEYEYSVECQEDSACPAAEESLPIEVMVDAVHKLKYENYT SSFFIRDIIKPDPPKNLQLKPLKNSRQVEVSWEYPDTWSTPHSYFSLTFCVQVQGK SKREKKDRVFTDKTSATVICRKNASISVRAQDRYYSSSWSEWASVPCS*GGGGGGS*R NLPVATPDPGMFPCLHHSQNLLRAVSNMLQKARQTLEFYPCTSEEIDHEDITKDKT STVEACLPLELTKNESCLNSRETSFITNGSCLASRKTSFMMALCLSSIYEDLKMYQ VEFKTMNAKLLMDPKRQIFLDQNMLAVIDELMQALNFNSETVPQKSSLEEPDFYKT KIKLCILLHAFRIRAVTIDRVMSYLNAS*SGGGSGGGGSGGGGSGGGGSGGGGSLQI**Y IWAPLAGTCGVLLLSLVITLYCY<br><br>Italic: signal peptide; Underline: IL12B; Dashed underline and Italic: linker; Bold: IL12A; Double underline: Transmembrane domain |
| 244 | h12AB-80TID Nucleotide Sequence 1 matched | ATGTGCCACCAGCAGCTGGTGATCAGCTGGTTCAGCCTGGTGTTCCTGGCCAGCCC CCTGGTGGCCATCTGGGAGCTGAAGAAGGACGTGTACGTGGTGGAGTTGGATTGGT ACCCCGACGCCCCCGGCGAGATGGTGGTGCTGACCTGCGACACCCCCGAGGAGGAC GGCATCACCTGGACCCTGGACCAGAGCAGCGAGGTGCTGGGCAGCGGCAAGACCCT GACCATCCAGGTGAAGGAGTTCGGCGACGCCGGCCAGTACACCTGCCACAAGGGCG GCGAGGTGCTGAGCCACAGCCTGCTGCTGCTGCACAAGAAGGAGGACGGCATCTGG AGCACCGACATCCTGAAGGACCAGAAGGAGCCCAAGAACAAGACCTTCCTGAGATG CGAGGCCAAGAACTACAGCGGCAGATTCACCTGCTGGTGGCTGACCACCATCAGCA CCGACCTGACCTTCAGCGTGAAGAGCAGCAGAGGCAGCAGCGACCCCCAGGGCGTG ACCTGCGGCGCCGCCACCCTGAGCGCCGAGAGAGTGAGAGGCGACAACAAGGAGTA CGAGTACAGCGTGGAGTGCCAGGAAGATAGCGCCTGCCCCGCCGCCGAGGAGAGCC TGCCCATCGAGGTGATGGTGGACGCCGTGCACAAGCTGAAGTACGAGAACTACACC AGCAGCTTCTTCATCAGAGATATCATCAAGCCCGACCCCCCCAAGAACCTGCAGCT GAAGCCCCTGAAGAACAGCCGGCAGGTGGAGGTGAGCTGGGAGTACCCCGACACCT GGAGCACCCCCCACAGCTACTTCAGCCTGACCTTCTGCGTGCAGGTGCAGGGCAAG AGCAAGAGAGAGAAGAAAGATAGAGTGTTCACCGACAAGACCAGCGCCACCGTGAT CTGCAGAAAGAACGCCAGCATCAGCGTGAGAGCCCAAGATAGATACTACAGCAGCA GCTGGAGCGAGTGGGCCAGCGTGCCCTGCAGCGGCGGCGGCGGCGGCGGCAGCAGA AACCTGCCCGTGGCCACCCCCGACCCCGGCATGTTCCCCTGCCTGCACCACAGCCA GAACCTGCTGAGAGCCGTGAGCAACATGCTGCAGAAGGCCCGGCAGACCCTGGAGT TCTACCCCTGCACCAGCGAGGAGATCGACCACGAAGATATCACCAAAGATAAGACC AGCACCGTGGAGGCCTGCCTGCCCCTGGAGCTGACCAAGAACGAGAGCTGCCTGAA CAGCAGAGAGACCAGCTTCATCACCAACGGCAGCTGCCTGGCCAGCAGAAAGACCA GCTTCATGATGGCCCTGTGCCTGAGCAGCATCTACGAGGACCTGAAGATGTACCAG GTGGAGTTCAAGACCATGAACGCCAAGCTGCTGATGGACCCCAAGCGGCAGATCTT CCTGGACCAGAACATGCTGGCCGTGATCGACGAGCTGATGCAGGCCCTGAACTTCA ACAGCGAGACCGTGCCCCAGAAGAGCAGCCTGGAGGAGCCCGACTTCTACAAGACC AAGATCAAGCTGTGCATCCTGCTGCACGCCTTCAGAATCAGAGCCGTGACCATCGA CAGAGTGATGAGCTACCTGAACGCCAGCTCTGGTGGCGGATCAGGCGGCGGCGGTT CAGGAGGCGGTGGAAGTGGAGGTGGCGGGTCTGGCGGAGGTTCACTGCAGCTGCTG CCCAGCTGGGCCATCACCCTGATCAGCGTGAACGGCATCTTCGTGATCTGCTGCCT GACCTACTGCTTCGCCCCTCGATGCAGAGAGAGAAGAAGAAACGAGAGACTGAGAA GAGAGAGCGTGCGACCCGTG |
| 245 | h12AB-80TID Nucleotide Sequence 2 SE_IL12_041 | ATGTGCCACCAGCAGCTGGTGATCAGCTGGTTCAGCCTGGTGTTCCTGGCCAGCCC TCTGGTGGCCATCTGGGAGCTGAAGAAGGACGTGTACGTGGTGGAGCTGGACTGGT ACCCTGACGCCCCTGGCGAGATGGTGGTGCTGACCTGCGACACCCCTGAGGAGGAC GGCATCACCTGGACCCTGGACCAGAGCAGCGAGGTGCTGGGCAGCGGCAAGACCCT GACCATCCAGGTGAAGGAGTTCGGCGACGCCGGCCAGTACACCTGCCACAAGGGCG GAGAGGTGTTAAGCCACAGCCTGCTCTTGCTACACAAGAAGGAGGACGGTATTTGG AGCACCGACATCCTGAAGGACCAGAAGGAGCCTAAGAACAAGACCTTCCTGAGGTG CGAGGCCAAGAACTACAGCGGCAGATTCACCTGCTGGTGGCTGACCACCATCTCCA CGGACCTGACCTTCAGCGTTAAGAGTAGCAGAGGCAGCAGCGACCCTCAGGGCGTG ACTTGTGGCGCCGCCACCCTGAGCGCCGAGAGAGTGAGAGGCGACAACAAGGAGTA CGAGTACAGCGTGGAGTGCCAGGAGGACAGCGCCTGCCCTGCCGCCGAGGAGAGCC TGCCTATCGAGGTGATGGTGGACGCCGTGCACAAGCTGAAGTACGAGAATTACACC TCATCCTTCTTCATCAGAGACATCATCAAGCCTGACCCTCCAAAGAATCTGCAGCT GAAGCCTCTGAAGAACAGCAGACAGGTGGAGGTGAGCTGGGAGTATCCGGATACCT GGAGCACACCTCACAGCTACTTCTCACTTACATTCTGCGTGCAGGTGCAGGGCAAG

SUMMARY OF SEQUENCES

| SEQ ID NO | Description | Sequence |
|---|---|---|
| | | AGCAAGAGAGAGAAGAAGGATAGAGTGTTCACCGACAAGACCAGCGCCACCGTGAT<br>CTGCAGAAAGAACGCCAGCATCTCAGTGAGAGCCCAGGACAGATACTACTCATCCT<br>CCTGGGAGCGAGTGGGCCAGCGTGCCTTGCTCCGGTGGTGGTGGCGGAGGCAGCAGA<br>AACCTGCCTGTGGCTACACCTGATCCTGGCATGTTCCCTTGCCTGCACCACAGCCA<br>GAACCTGCTGAGAGCCGTGAGCAACATGCTGCAGAAGGCCAGACAGACTCTGGAGT<br>CTCTACCCTTGCACCAGCGAGGAGATCGACCACGAGGACATCACCAAGGATAAGACA<br>AGCACCGTGGAGGCCTGCCTGCCTCTGGAGCTGACCAAGAACGAGAGCTGCCTAAA<br>CTCTAGGGAAACCAGCTTCATTACTAACGGCAGTTGCTTAGCCAGCCGGAAGACAT<br>CGTTCATGATGGCCCTGTGCCTGAGCAGCATCTACGAGGACCTGAAGATGTACCAA<br>GTGGAGTTCAAGACCATGAACGCCAAGCTGCTGATGGACCCTAAGAGACAGATCTT<br>CCTAGACCAGAACATGCTCGCCGTGATCGACGAGCTGATGCAGGCCCTGAACTTCA<br>ACAGCGAAACTGTGCCTCAGAAGAGTTCACTGGAGGAGCCTGACTTCTATAAGACT<br>AAGATCAAGCTGTGTATTCTCCTCCACGCCTTCAGAATCAGGGCTGTCACCATCGA<br>TAGGGTGATGAGCTACCTGAACGCATCGTCCGGCGGAGGATCCGGAGGAGGAGGCT<br>CCGGCGGTGGTGGAAGTGGAGGAGGTGGATCAGGAGGCGGTAGTCTCCAGCTCCTG<br>CCTAGCTGGGCCATCACCCTGATCTCTGTAAACGGCATTTTCGTCATTTGCTGTCT<br>GACTTACTGCTTCGCCCCTAGGTGCCGGGAGCGTAGGAGAAACGAGAGACTGCGCC<br>GGGAGTCCGTGCGGCCTGTG |
| 246 | h12AB-80TID Nucleotide Sequence 3 SE_IL12_042 | ATGTGTCACCAGCAGCTCGTGATCAGCTGGTTCAGCCTGGTGTTCCTGGCCTCCCC<br>GCTGGTGGCCATCTGGGAGCTGAAGAAGGACGTGTACGTGGTGGAGCTGGACTGGT<br>ACCCCGACGCTCCCGGCGAGATGGTGGTGCTGACCTGCGACACACCGGAGGAAGAC<br>GGAATCACCTGGACCCTGGACCAATCCTCCGAAGTTCTGGGCAGCGGCAAGACCCT<br>GACCATCCAGGTGAAGGAGTTCGGCGACGCCGGCCAGTACACCTGCCACAAGGGCG<br>GCGAGGTGCTGAGCCACAGCCTGCTCCTCCTCCACAAGAAAGAGGACGGCATCTGG<br>AGCACCGACATCCTGAAGGACCAGAAGGAGCCCAAGAACAAGACCTTCCTGCGGTG<br>CGAGGCCAAGAACTACTCAGGCCGATTCACCTGTTGGTGGCTCACAACTATCAGCA<br>CAGACCTGACCTTCAGCGTGAAGTCTAGCCGGGGCAGCAGCGATCCTCAGGGCGTG<br>ACCTGCGGCGCCGCCACCCTGAGCGCCGAGCGGGTGCGGGGCGACAACAAGGAGTA<br>CGAGTACAGCGTGGAGTGCCAGGAGGACAGCGCCTGCCCGGCCGCCGAAGAGTCCC<br>TGCCCATCGAGGTGATGGTGGACGCCGTGCACAAACTCAAGTACGAGAACTACACC<br>TCCAGCTTCTTCATCCGGGACATCATCAAGCCCGATCCGCCCAAGAACCTGCAGCT<br>GAAGCCCCTGAAGAACAGCCGGCAGGTGGAGGTGAGCTGGGAATACCCGGACACGT<br>GGTCCACCCCACACAGCTACTTCAGCCTGACCTTTTGCGTGCAGGTCCAAGGCAAG<br>AGCAAGCGGGAGAAGAAGGACCGGGTGTTCACCGATAAGACCTCAGCCACCGTGAT<br>TTGCAGAAAGAACGCATCCATATCCGTACGCGCCCAGGATCGGTACTACAGCAGCA<br>GCTGGAGCGAGTGGGCCAGCGTGCCCTGTAGCGGCGGCGGCGGTGGTGGGAGTCGC<br>AACCTGCCCGTGGCCACCCCGGACCCCGGCATGTTCCCCTGCCTGCACCACAGCCA<br>GAACCTGCTGCGGGCCGTGAGCAACATGCTGCAGAAGGCCCGGCAGACCCTGGAGT<br>TCTACCCCTGCACCAGCGAGGAGATCGACCACGAGGACATCACCAAGGACAAGACC<br>AGCACCGTGGAGGCCTGCCTGCCCCTGGAGCTGACCAAGAACGAGAGCTGCCTGAA<br>CAGTCGCGAAACCTCCTTCATTACGAACGGCAGCTGCCTGGCCAGCCGGAAGACCA<br>GCTTCATGATGGCCCTGTGCCTGAGCAGCATCTACGAGGACCTGAAGATGTACCAG<br>GTGGAGTTCAAGACCATGAACGCCAAGCTGCTGATGGACCCCAAGCGGCAGATCTT<br>CCTGGACCAGAACATGCTGGCCGTGATCGACGAGCTGATGCAGGCCCTGAACTTCA<br>ACAGCGAAACCGTGCCCCAGAAGTCCAGCCTGGAGGAGCCCGACTTCTACAAGACC<br>AAGATCAAGCTGTGCATCCTGCTGCACGCCTTCCGGATCCGGGCCGTGACCATCGA<br>CCGGGTGATGAGCTACCTGAACGCCTCTTCCGGTGGCGGGAGCGGAGGCGGTGGAT<br>CTGGCGGAGGAGGGTCGGGAGGCGGCGGAAGCGGTGGTGGAAGCCTTCAACTGCTG<br>CCCTCGTGGGCCATCACACTGATCTCCGTGAACGGCATCTTCGTGATCTGCTGCCT<br>GACCTACTGCTTCGCCCCTCGGTGCCGCGAGCGACGGAGAAACGAGAGGCTCAGAC<br>GGGAGAGCGTGCGGCCCGTG |
| 247 | h12AB-80TID Nucleotide Sequence 4 SE_IL12_043 | ATGTGCCACCAACAGCTGGTGATCAGCTGGTTCAGCCTGGTGTTCCTGGCCTCACC<br>CCTGGTGGCCATCTGGGAGCTGAAGAAGGACGTGTACGTGGTGGAGCTGGACTGGT<br>ACCCCGACGCCCCTGGCGAGATGGTGGTGCTGACCTGCGACACGCCCGAGGAAGAC<br>GGTATCACCTGGACTCTGGACCAGAGCAGCGAGGTGCTGGGCAGCGGCAAGACCCT<br>GACCATCCAGGTGAAGGAGTTCGGCGACGCCGGCCAGTACACCTGCCACAAGGGCG<br>GCGAAGTGCTGAGCCACAGCCTTCTGCTGCTGCACAAGAAGGAGGACGGCATTTGG<br>AGCACCGACATCCTGAAGGACCAGAAGGAGCCCAAGAACAAGACCTTCCTGCGGTG<br>CGAGGCCAAGAACTACAGCGGCCGGTTCACCTGCTGGTGGCTGACCACCATCAGCA<br>CCGACCTTACCTTCAGCGTTAAGAGCAGCCGGGGCAGCAGCGATCCCCAGGGCGTG<br>ACCTGCGGAGCCGCCACCCTCTCCGCAGAGCGGGTGCGTGGCGACAACAAGGAGTA<br>CGAGTACAGCGTGGAGTGCCAGGAGGATAGCGCCTGTCCCGCTGCCGAAGAGAGCC<br>TGCCCATCGAGGTGATGGTGGACGCCGTGCACAAGCTGAAGTACGAGAACTACACC<br>AGCAGCTTCTTCATCCGGGACATCATCAAGCCCGATCCACCCAAGAACCTGCAGCT<br>GAAGCCCCTGAAGAACAGCAGGCAGGTTGAGGTGAGCTGGGAATACCCGACACCT<br>GGAGCACCCCTCACAGCTACTTCAGCCTGACCTTCTGCGTGCAGGTCAGGGCAAG<br>AGCAAGCGGGAGAAGAAGGATCGGGTGTTCACCGATAAGACCAGCGCCACCGTGAT<br>CTGCCGGAAGAACGCCAGCATCAGCGTTCGGGCCCAGGACCGGTACTACAGCAGCA<br>GCTGGAGCGAGTGGGCCAGCGTGCCCTGCTCTGGAGGCGGAGGCGGAGGCTCACGG<br>AACCTGCCAGTGGCCACGCCGGATCCCGGCATGTTCCCCTGCCTGCACCACAGCCA<br>GAACCTGCTGCGGGCCGTGAGCAACATGCTGCAGAAGGCCCGGCAGACCCTGGAGT |

| SEQ ID NO | Description | Sequence |
|---|---|---|
| | | TCTACCCCTGCACCAGCGAGGAGATCGACCACGAGGACATCACCAAGGACAAGACC<br>AGCACCGTGGAGGCCTGCCTGCCCCTGGAGCTGACCAAGAACGAGAGCTGCCTGAA<br>CAGCCGGGAGACAAGCTTCATCACCAACGGCAGCTGCCTGGCCAGCCGGAAGACCA<br>GCTTCATGATGGCCCTGTGCCTGAGCAGCATCTACGAGGACCTGAAGATGTACCAG<br>GTGGAGTTCAAGACCATGAACGCCAAGCTGCTGATGGACCCCAAGCGGCAGATCTT<br>CCTGGATCAGAACATGCTGGCCGTGATCGACGAGCTGATGCAGGCCCTGAACTTCA<br>ACAGCGAGACTGTGCCCCAGAAGTCCAGCCTGGAGGAGCCCGACTTCTACAAGACC<br>AAGATCAAGCTGTGCATCCTGCTGCACGCCTTCCGGATCCGGGCTGTGACCATCGA<br>CCGGGTGATGAGCTACCTGAACGCCTCTTCCGGCGGCGGATCGGGAGGTGGAGGTT<br>CTGGAGGAGGTGGAAGCGGTGGTGGCGGAAGCGGCGGTGGCAGCCTGCAATTGCTC<br>CCCAGCTGGGCCATCACCCTGATCAGCGTGAACGGCATCTTCGTGATCTGTTGCCT<br>GACCTACTGCTTCGCCCCACGGTGCCGGGAGAGACGGCGGAACGAGCGGCTGCGGC<br>GAGAGAGCGTGCGGCCCGTG |
| 248 | h12AB-80TID<br>Nucleotide<br>Sequence 5<br>SE_IL12_044 | ATGTGTCACCAGCAGTTGGTGATATCTTGGTTCTCACTGGTGTTTCTTGCATCACC<br>ACTCGTGGCGATCTGGGAACTTAAGAAGGACGTCTACGTGGTGGAGTTAGATTGGT<br>ATCCTGACGCACCCGGGGAAATGGTTGTCCTCACGTGCGACACTCCAGAGGAAGAC<br>GGGATCACCTGGACCCTGGATCAGTCGTCAGAGGTACTTGGCAGTGGCAAGACACT<br>GACAATCCAGGTTAAAGAGTTTGGTGACGCCGGGCAGTATACGTGCCACAAGGGCG<br>GCGAGGTGTTGTCACATTCTCTGCTTCTCCTGCACAAGAAAGAAGACGGCATCTGG<br>TCAACTGACATCCTGAAAGACCAGAAAGAACCCAAGAATAAGACCTTCCTCCGTTG<br>CGAAGCAAAGAACTACTCAGGGCGTTTCACTTGCTGGTGGCTAACCACAATTTCTA<br>CCGATCTGACGTTCTCTGTGAAGTCAAGTAGGGGATCCTCAGACCCTCAAGGGGTC<br>ACCTGCGGCGCCGCCACCTTATCCGCCGAAAGAGTTCGGGGTGACAATAAAGAGTA<br>CGAGTACAGCGTCGAGTGTCAGGAGGACTCCGCCTGTCCTGCTGCAGAGGAGTCCC<br>TGCCGATCGAAGTTATGGTGGACGCCGTCCACAAGCTCAAATACGAGAACTACACC<br>TCAAGCTTCTTCATCAGAGACATCATCAAGCCTGATCCACCCAAGAACCTGCAACT<br>GAAGCCTTTGAAGAACAGCCGACAGGTGGAGGTTTCTTGGGAATATCCAGACACGT<br>GGAGTACGCCCCATTCCTACTTCAGCTTGACCTTCTGCGTGCAGGTTCAGGGGAAG<br>TCCAAGAGAGAGAAGAAGGATCGTGTGTTCACAGACAAGACCTCCGCCACCGTGAT<br>CTGCCGGAAGAACGCATCTATCAGTGTTAGGGCCCAGGATCGGTACTACTCGAGTT<br>CCTGGTCTGAGTGGGCAAGTGTGCCCTGCTCCGGTGGCGGCGGAGGAGGGTCAAGG<br>AACCTGCCCGTTGCCACACCAGATCCAGGAATGTTCCCCTGTCTGCACCACTCTCA<br>GAACCTTTTGCGAGCCGTTTCTAATATGCTTCAGAAGGCTCGGCAGACCCTTGAGT<br>TTTATCCCTGCACGTCTGAGGAGATCGATCACGAGGACATCACCAAGGACAAGACT<br>TCCACCGTTGAAGCCTGTTTACCTCTGGAACTGACCAAGAACGAATCCTGTCTCAA<br>CAGTAGGGAAACGAGCTTCATCACTAACGGAAGCTGTCTGGCTAGCCGGAAGACCT<br>CTTTTATGATGGCCCTGTGCTTGAGCTCTATTTACGAAGATTTGAAGATGTACCAA<br>GTGGAATTTAAGACTATGAACGCCAAACTGCTGATGGACCCTAAGCGCCAAATCTT<br>CTTGGATCAGAATATGCTGGCTGTAATCGACGAGCTCATGCAGGCTCTGAACTTCA<br>ACAGCGAGACGGTACCGCAGAAGAGTTCCCTGGAAGAACCGGACTTCTACAAGACT<br>AAGATTAAACTCTGCATACTCCTCCACGCCTTCCGGATCAGGGCCGTCACAATAGA<br>TAGGGTCATGAGTTATCTTAACGCGAGTTCTGGTGGTGGATCGGGTGGCGGAGGCT<br>CAGGAGGAGGCGGTTCTGGCGGTGGTGGGAGTGGAGGCGGTAGTCTGCAGCTGCTG<br>CCGAGTTGGGCAATCACGCTAATCAGCGTGAACGGAATATTCGTAATTTGTTGCCT<br>CACCTATTGTTTCGCACCCAGGTGCAGGGAAAGGAGGCGAAACGAAAGGTTGAGGA<br>GGGAATCTGTCCGGCCAGTG |
| 249 | h12AB-80TID<br>Amino Acid<br>Sequence 1<br>(Corresponds<br>to nucleotide<br>sequences 1-5) | *MCHQQLVISWFSLVFLASPLVA*IWELKKDVYVVELDWYPDAPGEMVVLTCDTPEED<br>GITWTLDQSSEVLGSGKTLTIQVKEFGDAGQYTCHKGGEVLSHSLLLLHKKEDGIW<br>STDILKDQKEPKNKTFLRCEAKNYSGRFTCWWLTTISTDLTFSVKSSRGSSDPQGV<br>TCGAATLSAERVRGDNKEYEYSVECQEDSACPAAEESLPIEVMVDAVHKLKYENYT<br>SSFFIRDIIKPDPPKNLQLKPLKNSRQVEVSWEYPDTWSTPHSYFSLTFCVQVQGK<br>SKREKKDRVFTDKTSATVICRKNASISVRAQDRYYSSSWSEWASVPCS*GGGGGGS*R<br>NLPVATPDPGMFPCLHHSQNLLRAVSNMLQKARQTLEFYPCTSEEIDHEDITKDKT<br>STVEACLPLELTKNESCLNSRETSFITNGSCLASRKTSFMMALCLSSIYEDLKMYQ<br>VEFKTMNAKLLMDPKRQIFLDQNMLAVIDELMQALNFNSETVPQKSSLEEPDFYKT<br>KIKLCILLHAFRIRAVTIDRVMSYLNAS*SGGGSGGGGSGGGGSGGGGSGGGGS*LQLL<br>PSWAITLISVNGIFVICCL*TYCFAPRCRERRRNERLRRESVRPV* |

Italic: signal peptide; Underline: IL12B; Dashed underline and Italic: linker; Bold: IL12A; Double underline: Transmembrane domain; Bold and Italic: Intracellular domain -continued

SUMMARY OF SEQUENCES

| SEQ ID NO | Description | Sequence |
|---|---|---|
| 250 | Human PGFRB transmembrane domain nucleotide sequence | GUGGUGGUGAUCAGCGCCAUCCUGGCCCUGGUGGUGCUGACCAUCAUCAGCCUGAU CAUCCUGAUCAUGCUGUGG |
| 251 | Human PGFRB E570tr intracellular domain nucleotide sequence | CAGAAGAAGCCCAGAUACGAGAUCAGAUGGAAGGUGAUCGAGAGCGUGAGCAGCGA CGGCCACGAG |
| 252 | h12AB-PTM-ICD-E570tr Nucleotide Sequence | ATGTGCCACCAGCAGCTGGTGATCAGCTGGTTCAGCCTGGTGTTCCTGGCCAGCCC CCTGGTGGCCATCTGGGAGCTGAAGAAGGACGTGTACGTGGTGGAGTTGGATTGGT ACCCCGACGCCCCCGGCGAGATGGTGGTGCTGACCTGCGACACCCCCGAGGAGGAC GGCATCACCTGGACCCTGGACCAGACAGCAGGTGCTGGGCAGCGGCAAGACCCT GACCATCCAGGTGAAGGAGTTCGGCGACGCCGGCCAGTACACCTGCCACAAGGGCG GCGAGGTGCTGAGCCACAGCCTGCTGCTGCTGCACAAGAAGGAGGACGGCATCTGG AGCACCGACATCCTGAAGGACCAGAAGGAGCCCAAGAACAAGACCTTCCTGAGATG CGAGGCCAAGAACTACAGCGGCAGATTCACCTGCTGGTGGCTGACCACCATCAGCA CCGACCTGACCTTCAGCGTGAAGAGCAGCAGAGGCAGCAGCGACCCCCAGGGCGTG ACCTGCGGCGCCGCCACCCTGAGCGCCGAGAGTGAGAGGCGACAACAAGGAGTA CGAGTACAGCGTGGAGTGCCAGGAAGATAGCGCCTGCCCCGCCGCCGAGGAGAGCC TGCCCATCGAGGTGATGGTGGACGCCGTGCACAAGCTGAAGTACGAGAACTACACC AGCAGCTTCTTCATCAGAGATATCATCAAGCCCGACCCCCCCAAGAACCTGCAGCT GAAGCCCCTGAAGAACAGCCGGCAGGTGGAGGTGAGCTGGGAGTACCCCGACACCT GGAGCACCCCCCACAGCTACTTCAGCCTGACCTTCTGCGTGCAGGTGCAGGGCAAG AGCAAGAGAGAGAAGAAAGATAGAGTGTTCACCGACAAGACCAGCGCCACCGTGAT CTGCAGAAAGAACGCCAGCATCAGCGTGAGAGCCCAAGATAGATACTACAGCAGCA GCTGGAGCGAGTGGGCCAGCGTGCCCTGCAGCGGCGGCGGCGGCGGCGGCAGCAGA AACCTGCCCGTGGCCACCCCCGACCCCGGCATGTTCCCCTGCCTGCACCACAGCCA GAACCTGCTGAGAGCCGTGAGCAACATGCTGCAGAAGGCCCGGCAGACCCTGGAGT TCTACCCCTGCACCAGCGAGGAGATCGACCACGAAGATATCACCAAAGATAAGACC AGCACCGTGGAGGCCTGCCTGCCCCTGGAGCTGACCAAGAACGAGAGCTGCCTGAA CAGCAGAGAGACCAGCTTCATCACCAACGGCAGCTGCCTGGCCAGCAGAAAGACCA GCTTCATGATGGCCCTGTGCCTGAGCAGCATCTACGAGGACCTGAAGATGTACCAG GTGGAGTTCAAGACCATGAACGCCAAGCTGCTGATGGACCCCAAGCGGCAGATCTT CCTGGACCAGAACATGCTGGCCGTGATCGACGAGCTGATGCAGGCCCTGAACTTCA ACAGCGAGACCGTGCCCCAGAAGAGCAGCCTGGAGGAGCCCGACTTCTACAAGACC AAGATCAAGCTGTGCATCCTGCTGCACGCCTTCAGAATCAGAGCCGTGACCATCGA CAGAGTGATGAGCTACCTGAACGCCAGCTCTGGTGGCGGATCAGGCGGCGGCGGTT CAGGAGGCGGTGGAAGTGGAGGTGGCGGGTCTGGCGGAGGTTCACTGCAGGTGGTG GTGATCAGCGCCATCCTGGCCCTGGTGGTGCTCACCATCATCAGCCTGATCATCCT GATCATGCTGTGGCAGAAGAAGCCCAGATACGAGATCCGGTGGAAGGTGATCGAGA GCGTGAGCAGCGACGGCCACGAGTTCATCTTCGTGGACCCCATGCAGCTGCCCTAC GACAGCACCTGGGAGCTGCCCCGTGATCAGCTGGTGCTGGGCAGAACCCTGGGCAG CGGCGCCTTCGGCCAGGTGGTGGAGGCTACCGCCCACGGCCTGAGCCACAGCCAGG CCACCATGAAGGTGGCCGTGGCCATGCTCAAGAGCACCGCCAGAAGCAGCGAGAAG CAGGCCCTGATGAGCGAGCTGAAGATCATGAGCCATCTGGGGCCCCACCTGAACGT GGTGAACCTGCTGGGCGCCTGCACCAAGGGCGGCCCCATCTACATCATCACCGAGT ACTGCAGATACGGCGACCTGGTGGACTACCTGCACAGAAACAAGCACACCTTCCTG CAGCACCACAGCGACAAGAGAAGACCTCCCAGCGCCGAGCTGTACAGCAACGCCCT GCCCGTTGGTCTGCCCCTACCCAGCCACGTGAGCCTGACCGGCGAGAGCGACGGCG GC |

SUMMARY OF SEQUENCES

| SEQ ID NO | Description | Sequence |
|---|---|---|
| 253 | h12AB-PTM-ICD-E570tr Amino Acid Sequence | *MCHQQLVISWFSLVFLASPLVA*IWELKKDVYVVELDWYPDAPGEMVVLTCDTPEED GITWTLDQSSEVLGSGKTLTIQVKEFGDAGQYTCHKGGEVLSHSLLLLHKKEDGIW STDILKDQKEPKNKTFLRCEAKNYSGRFTCWWLTTISTDLTFSVKSSRGSSDPQGV TCGAATLSAERVRGDNKEYEYSVECQEDSACPAAEESLPIEVMVDAVHKLKYENYT SSFFIRDIIKPDPPKNLQLKPLKNSRQVEVSWEYPDTWSTPHSYFSLTFCVQVQGK SKREKKDRVFTDKTSATVICRKNASISVRAQDRYYSSSWSEWASVPCS*GGGGGGS*R NLPVATPDPGMFPCLHHSQNLLRAVSNMLQKARQTLEFYPCTSEEIDHEDITKDKT STVEACLPLELTKNESCLNSRETSFITNGSCLASRKTSFMMALCLSSIYEDLKMYQ VEFKTMNAKLLMDPKRQIFLDQNMLAVIDELMQALNFNSETVPQKSSLEEPDFYKT KIKLCILLHAFRIRAVTIDRVMSYLNAS*SGGGSGGGGSGGGGSGGGGSGGGSLQVV VISAILALVVLTIISLIILIMLW*QKKPRYEIRWKVIESVSSDGHE*** <br><br>Italic: signal peptide; Underline: IL12B; Dashed underline and Italic: linker; Bold: IL12A; Double underline: Transmembrane domain; Bold and Italic: Intracellular domain |
| 254 | h12AB-PTM-ICD-G739tr Nucleotide Sequence | ATGTGCCACCAGCAGCTGGTGATCAGCTGGTTCAGCCTGGTGTTCCTGGCCAGCCC CCTGGTGGCCATCTGGGAGCTGAAGAAGGACGTGTACGTGGTGGAGTTGGATTGGT ACCCCGACGCCCCCGGCGAGATGGTGGTGCTGACCTGCGACACCCCCGAGGAGGAC GGCATCACCTGGACCCTGGACCAGAGCAGCGAGGTGCTGGGCAGCGGCAAGACCCT GACCATCCAGGTGAAGGAGTTCGGCGACGCCGGCCAGTACACCTGCCACAAGGGCG GCGAGGTGCTGAGCCACAGCCTGCTGCTGCTGCACAAGAAGGAGGACGGCATCTGG AGCACCGACATCCTGAAGGACCAGAAGGAGCCCAAGAACAAGACCTTCCTGAGATG CGAGGCCAAGAACTACAGCGGCAGATTCACCTGCTGGTGGCTGACCACCATCAGCA CCGACCTGACCTTCAGCGTGAAGAGCAGCAGAGGCAGCAGCGACCCCCAGGGCGTG ACCTGCGGCGCCGCCACCCTGAGCGCCGAGAGTGAGAGGCGACAACAAGGAGTA CGAGTACAGCGTGGAGTGCCAGGAAGATAGCGCCTGCCCCGCCGCCGAGGAGAGCC TGCCCATCGAGGTGATGGTGGACGCCGTGCACAAGCTGAAGTACGAGAACTACACC AGCAGCTTCTTCATCAGAGATATCATCAAGCCCGACCCCCCCAAGAACCTGCAGCT GAAGCCCCTGAAGAACAGCCGGCAGGTGGAGGTGAGCTGGGAGTACCCCGACACCT GGAGCACCCCCCACAGCTACTTCAGCCTGACCTTCTGCGTGCAGGTGCAGGGCAAG AGCAAGAGAGAGAAGAAAGATAGAGTGTTCACCGACAAGACCAGCGCCACCGTGAT CTGCAGAAAGAACGCCAGCATCAGCGTGAGAGCCCAAGATAGATACTACAGCAGCA GCTGGAGCGAGTGGGCCAGCGTGCCCTGCAGCGGCGGCGGCGGCGGCGGCAGCAGA AACCTGCCCGTGGCCACCCCCGACCCCGGCATGTTCCCCTGCCTGCACCACAGCCA GAACCTGCTGAGAGCCGTGAGCAACATGCTGCAGAAGGCCCGGCAGACCCTGGAGT TCTACCCCTGCACCAGCGAGGAGATCGACCACGAAGATATCACCAAAGATAAGACC AGCACCGTGGAGGCCTGCCTGCCCCTGGAGCTGACCAAGAACGAGAGCTGCCTGAA CAGCAGAGAGACCAGCTTCATCACCAACGGCAGCTGCCTGGCCAGCAGAAAGACCA GCTTCATGATGGCCCTGTGCCTGAGCAGCATCTACGAGGACCTGAAGATGTACCAG GTGGAGTTCAAGACCATGAACGCCAAGCTGCTGATGGACCCCAAGCGGCAGATCTT CCTGGACCAGAACATGCTGGCCGTGATCGACGAGCTGATGCAGGCCCTGAACTTCA ACAGCGAGACCGTGCCCCAGAAGAGCAGCCTGGAGGAGCCCGACTTCTACAAGACC AAGATCAAGCTGTGCATCCTGCTGCACGCCTTCAGAATCAGAGCCGTGACCATCGA CAGAGTGATGAGCTACCTGAACGCCAGCTCTGGTGGCGGATCAGGCGGCGGCGGTT CAGGAGGCGGTGGAAGTGGAGGTGGCGGGTCGGCGGAGGTTCACTGCAGGTGGTG GTGATCAGCGCCATCCTGGCCCTGGTGGTGCTCACCATCATCAGCCTGATCATCCT GATCATGCTGTGGCAGAAGAAGCCCAGATACGAGATCCGGTGGAAGGTGATCGAGA GCGTGAGCAGCGACGGCCACGAGTTCATCTTCGTGGACCCCATGCAGCTGCCCTAC GACAGCACCTGGGAGCTGCCCCGTGATCAGCTGGTGCTGGGCAGAACCCTGGGCAG CGGCGCCTTCGGCCAGGTGGTGGAGGCTACCGCCCACGGCCTGAGCCACAGCCAGG CCACCATGAAGGTGGCCGTGGCCATGCTCAAGAGCACCGCCAGAAGCAGCGAGAAG CAGGCCCTGATGAGCGAGCTGAAGATCATGAGCCATCTGGGGCCCCACCTGAACGT GGTGAACCTGCTGGGCGCCTGCACCAAGGGCGGCCCCATCTACATCATCACCGAGT ACTGCAGATACGGCGACCTGGTGGACTACCTGCACAGAAACAAGCACACCTTCCTG CAGCACCACAGCGACAAGAGAAGACCTCCCAGCGCCGAGCTGTACAGCAACGCCCT GCCCGTTGGTCTGCCCCTACCCAGCCACGTGAGCCTGACCGGCGAGAGCGACGGCG GC |

SUMMARY OF SEQUENCES

| SEQ ID NO | Description | Sequence |
|---|---|---|
| 255 | h12AB-PTM-ICD-G739tr Amino Acid Sequence | *MCHQQLVISWFSLVFLASPLVA*IWELKKDVYVVELDWYPDAPGEMVVLTCDTPEED GITWTLDQSSEVLGSGKTLTIQVKEFGDAGQYTCHKGGEVLSHSLLLLHKKEDGIW STDILKDQKEPKNKTFLRCEAKNYSGRFTCWWLTTISTDLTFSVKSSRGSSDPQGV TCGAATLSAERVRGDNKEYEYSVECQEDSACPAAEESLPIEVMVDAVHKLKYENYT SSFFIRDIIKPDPPKNLQLKPLKNSRQVEVSWEYPDTWSTPHSYFSLTFCVQVQGK SKREKKDRVFTDKTSATVICRKNASISVRAQDRYYSSSWSEWASVPCS*GGGGGGS*R NLPVATPDPGMFPCLHHSQNLLRAVSNMLQKARQTLEFYPCTSEEIDHEDITKDKT STVEACLPLELTKNESCLNSRETSFITNGSCLASRKTSFMMALCLSSIYEDLKMYQ VEFKTMNAKLLMDPKRQIFLDQNMLAVIDELMQALNFNSETVPQKSSLEEPDFYKT KIKLCILLHAFRIRAVTIDRVMSYLNAS*SGGGSGGGGSGGGGSGGGGSGGGSLQVV VISAILALVVLTIISLIILIMLW_QKKPRYEIRWKVIESVSSDGHEFIFVDPMQLPY DSTWELPRDQLVLGRTLGSGAFGQVVEATAHGLSHSQATMKVAVAMLKSTARSSEK QALMSELKIMSHLGPHLNVVNLLGACTKGGPIYIITEYCRYGDLVDYLHRNKHTFL QHHSDKRRPPSAELYSNALPVGLPLPSHVSLTGESDGG_*<br><br>Italic: signal peptide; Underline: IL12B; Dashed underline and Italic: linker; Bold: IL12A; Double underline: Transmembrane domain; Bold and Italic: Intracellular domain |
| 256 | [CCG]₄ | CCGCCGCCGCCG |
| 257 | [CCG]₅ | CCGCCGCCGCCGCCG |
| 258 | V1 GC-rich RNA element | CCCCGGCGCC |
| 259 | V2 GC-rich RNA element | CCCCGGC |
| 260 | EK GC-rich RNA element | GCCGCC |
| 261 | 5'UTR | GGGAAATAAGAGAGAAAAGAAGAGTAAGAAGAAATATAAGA |
| 262 | V1-5' UTR | GGGAAATAAGAGAGAAAAGAAGAGTAAGAAGAAATATAAGACCCCGGCGCCGCCACC |
| 263 | V2-5'UTR | GGGAAATAAGAGAGAAAAGAAGAGTAAGAAGAAATATAAGACCCCGGCGCCACC |
| 264 | Standard 5'UTR | GGGAAATAAGAGAGAAAAGAAGAGTAAGAAGAAATATAAGAGCCACC |
| 265 | Kozak consensus | GCCA/GCC |
| 266 | 3'UTR with mir-122-5p binding site | TGATAATAGGCTGGAGCCTCGGTGGCCTAGCTTCTTGCCCCTTGGGCCTCCCCCCA GCCCCTCCTCCCCTTCCTGCACCCGTACCCCCCAAACACCATTGTCACACTCCAGT GGTCTTTGAATAAAGTCTGAGTGGGCGGC |
| 267 | mIL12AB-04-001 | GGGAAAUAAGAGAGAAAAGAAGAGUAAGAAGAAAUAUAAGAGCCACCAUGUGUCCU CAGAAGCUAACCAUCUCCUGGUUUGCCAUCGUUUUGCUGGUGUCUCCACUCAUGGC CAUGUGGGAGCUGGAGAAAGACGUUUAUGUUGUAGAGGUGGACUGGACUCCCGAUG CCCCUGGAGAAAUGGUGAACCUCACCUGUGACACGCCUGAAGAAGAUGACAUCACC UGGACCUCAGACCAGAGACAUGGAGUCAUAGGCUCUGGAAAGACCCUGACCAUCAC UGUCAAAGAGUUCCUAGAUGCUGGCCAGUACACCUGCCACAAAGGAGGCGAGACUC UGAGCCACUCACAUCUGCUGCUCCACAAGAAGGAAAAUGGAAUUUGGUCCACUGAA AUUUUAAAAAAUUUCAAAAACAAGACUUUCCUGAAGUGUGAAGCACCAAAUUACUC CGGACGGUUCACGUGCUCAUGGCUGGUGCAAAGAAACAUGGACUUGAAGUUCAACA UCAAGAGCAGUAGCAGUUCCCCUGACUCUCGGGCAGUGACAUGUGGAAUGGCGUCU CUGUCUGCAGAGAAGGUCACACUGGACCAAAGGGACUAUGAGAAGUAUUCAGUGUC CUGCCAGGAGGAUGUCACCUGCCCAACUGCCGAGGAGACCCUGCCCAUUGAACUGG CGUUGGAAGCACGGCAGCAGAAUAAAUAUGAGAACUACAGCACCAGCUUCUUCAUC |

| SEQ ID NO | Description | Sequence |
|---|---|---|
| | | AGGGACAUCAUCAAACCAGACCCGCCCAAGAACUUGCAGAUGAAGCCUUUGAAGAA<br>CUCACAGGUGGAGGUCAGCUGGGAGUACCCUGACUCCUGGAGCACUCCCCAUUCCU<br>ACUUCUCCCUCAAGUUCUUUGUUCGAAUCCAGCGCAAGAAAGAAAAGAUGAAGGAG<br>ACAGAGGAGGGUGUAACCAGAAAGGUGCGUUCCUCGUAGAGAAGACAUCUACCGA<br>AGUCCAAUGCAAAGGCGGGAAUGUCUGCGUGCAAGCUCAGGAUCGCUAUUACAAUU<br>CCUCAUGCAGCAAGUGGGCAUGUGUUCCCUGCAGGGUCCGAUCCGGAGGCGGAGGG<br>AGCGGAGGCGGAGGGAGCGGAGGCGGAGGGAGCAGGGUCAUUCCAGUCUCUGGACC<br>UGCCAGGUGUCUUAGCCAGUCCCGAAACCUGCUGAAGACCACAGAUGACAUGGUGA<br>AGACGGCCAGAGAAAAACUGAAACAUUAUUCCUGCACUGCUGAAGACAUCGAUCAU<br>GAAGACAUCACACGGGACCAAACCAGCACAUUGAAGACCUGUUUACCACUGGAACU<br>ACACAAGAACGAGAGUUGCCUGGCUACUAGAGAGACUUCUUCCACAACAAGAGGGA<br>GCUGCCUGCCCCCACAGAAGACGUCUUUGAUGAUGACCCUGUGCCUUGGUAGCAUC<br>UAUGAGGACUUGAAGAUGUACCAGACAGAGUUCCAGGCCAUCAACGCAGCACUUCA<br>GAAUCACAACCAUCAGCAGAUCAUUUUAGACAAGGGCAUGCUGGUGGCCAUCGAUG<br>AGCUGAUGCAGUCUCUGAAUCAUAAUGGCGAGACUCUGCGCCAGAAACCUCCUGUG<br>GGAGAAGCAGACCCUUACAGAGUGAAAAUGAAGCUCUGCAUCCUGCUUCACGCCUU<br>CAGCACCCGCGUCGUGACCAUCAACAGGGUGAUGGGCUAUCUGAGCUCCGCCUGAU<br>AAUAGGCUGGAGCCUCGGUGGCCAUGCUUCUUGCCCCUUGGGCCUCCCCCCAGCCC<br>CUCCUCCCCUUCCUGCACCCGUACCCCCCAAACACCAUUGUCACACUCCAGUGGUC<br>UUUGAAUAAAGUCUGAGUGGGCGGC |
| 268 | mIL12AB 80TM-nolinker_ V5_ Nucleotide Sequence | AUGUGUCCUCAGAAGCUAACCAUCUCCUGGUUUGCCAUCGUUUUGCUUGUGUCUCC<br>ACUCAUGGCCAUGUGGGAGCUCGAGAAAGACGUUUACGUUGUAGAGGUGGACUGGA<br>CUCCCGACGCCCCCAGGAGAAACAGUGAACCUCACCUGUGACACGCCUGAAGAAGAU<br>GACAUCACCUGGACCUCAGACCAGAGACAUGGAGUCAUAGGCUCUGGAAAGACCCU<br>GACCAUCACUGUCAAAGAGUUCCUAGAUGCUGGCCAGUACACCUGCCACAAAGGAG<br>GCGAGACUCUGAGCCACUCACAUCUGCUGCUCCACAAGAAGGAGAAUGGAAUUUGG<br>UCCACUGAGAUCCUGAAGAACUUCAAGAAUAAGACUUUCCUGAAGUGUGAAGCACC<br>AAAUUACUCCGGACGGUUCACGUGCUCAUGGCUGGUGCAAAGAAACAUGGACUUGA<br>AGUUCAACAUCAAGAGCAGUAGCAGUUCCCCUGACUCUCGGGCAGUGACAUGUGGA<br>AUGGCGUCUCUGUCUGCAGAGAAGGUCACACUGGACCAAAGGGACUAUGAGAAGUA<br>UUCAGUGUCCUGCCAGGAGGAUGUCACCUGCCCAACUGCCGAGGAGACACUGCCCA<br>UUGAACUGGCGUUGGAAGCACGGCAGCAGAAUAAAUAUGAGAACUACAGCACCAGC<br>UUCUUCAUCAGGGACAUCAUCAAACCAGACCCGCCCAAGAACUUGCAGAUGAAGCC<br>UUUGAAGAACUCACAGGUGGAGGUCAGCUGGGAGUACCCGGACUCCUGGAGCACUC<br>CCCAUUCCUACUUCUCCCUCAAGUUCUUUGUUCGAAUCCAGCGCAAGAAAGAGAAG<br>AUGAAGGAGACAGAGGAGGGGUGUAACCAGAAAGGUGCGUUCCUCGUAGAGAAGAC<br>AUCUACCGAAGUCCAAUGCAAAGGCGGGAAUGUCUGCGUGCAAGCUCAGGAUCGCU<br>AUUACAAUUCCUCAUGCAGCAAGUGGGCAUGUGUUCCCUGCAGGGUCCGAUCCGGA<br>GGCGGAGGGAGCGGUGGUGGAGGCAGCGGAGGAGGUGGAUCAAGGGUCAUUCCAGU<br>CUCUGGACCAGCUAGAUGUCUUAGCCAGUCCCGAAACCUGCUGAAGACCACGGACG<br>ACAUGGUGAAGACGGCCAGAGAGAAACUGAAACAUUAUUCCUGCACCGCAGAGGAU<br>AUCGAUCACGAAGAUAUCACACGGGACCAAACCAGCACAUUGAAGACCUGUUUACC<br>ACUGGAACUACACAAGAACGAGAGUUGCCUGGCUACUAGAGAGACUUCUUCCACAA<br>CAAGAGGGAGCUGCCUGCCACCACAGAAGACGUCUUUGAUGAUGACCCUGUGCCUU<br>GGUAGCAUCUAUGAGGACCUCAAGAUGUACCAGACAGAGUUCCAGGCCAUCAACGC<br>AGCACUUCAGAAUCACAACCAUCAGCAGAUCAUUUUAGACAAGGGCAUGCUGGUGG<br>CCAUCGAUGAGCUGAUGCAAUCAUUGAAUCAUAACGGUGAGACAUUGCGCCAGAAA<br>CCUCCUGUGGGAGAAGCAGACCCUUACAGAGUGAAGAUGAAGCUCUGCAUCCUGCU<br>UCACGCCUUCAGCACCCGCGUCGUCACUAUCAACAGGGUGAUGGGCUAUCUGAGCU<br>CCGCCACCCUGGUGCUGUUCGGCGCCGGCUUCGGUGCAGUGAUCACCGUGGUGGUG<br>AUCGUCGUCAUCAUCGGGAAACCAAUUCCAAAUCCCCUCCUGGGGUUGGAUAGCAC<br>C |
| 269 | mIL12AB-PTM_v5 miR122 Nucleotide Sequence | AUGUGUCCUCAGAAGCUAACCAUCUCCUGGUUUGCCAUCGUUUUGCUUGUGUCUCC<br>ACUCAUGGCCAUGUGGGAGCUCGAGAAAGACGUUUACGUUGUAGAGGUGGACUGGA<br>CUCCCGACGCCCCCAGGAGAAACAGUGAACCUCACCUGUGACACGCCUGAAGAAGAU<br>GACAUCACCUGGACCUCAGACCAGAGACAUGGAGUCAUAGGCUCUGGAAAGACCCU<br>GACCAUCACUGUCAAAGAGUUCCUAGAUGCUGGCCAGUACACCUGCCACAAAGGAG<br>GCGAGACUCUGAGCCACUCACAUCUGCUGCUCCACAAGAAGGAGAAUGGAAUUUGG<br>UCCACCGAAAUCCUGAAGAACUUCAAGAAUAAGACUUUCCUGAAGUGUGAAGCACC<br>AAAUUACUCCGGACGGUUCACGUGCUCAUGGCUGGUGCAAAGAAACAUGGACUUGA<br>AGUUCAACAUCAAGAGCAGUAGCAGUUCCCCUGACUCUCGGGCAGUGACAUGUGGA<br>AUGGCGUCUCUGUCUGCAGAGAAGGUCACACUGGACCAAAGGGACUAUGAGAAGUA<br>UUCAGUGUCCUGCCAGGAGGAUGUCACCUGCCCAACUGCCGAGGAAACUCUGCCCA<br>UUGAACUGGCGUUGGAAGCACGGCAGCAGAAUAAAUAUGAGAACUACAGCACCAGC<br>UUCUUCAUCAGGGACAUCAUCAAACCAGACCCGCCCAAGAACUUGCAGAUGAAGCC<br>UUUGAAGAACUCACAGGUGGAGGUCAGCUGGGAGUACCCAGACUCCUGGAGCACUC<br>CCCAUUCCUACUUCUCCCUCAAGUUCUUUGUUCGAAUCCAGCGCAAGAAAGAGAAG<br>AUGAAGGAGACAGAGGAGGGGUGUAACCAGAAAGGUGCGUUCCUCGUAGAGAAGAC<br>AUCUACCGAAGUCCAAUGCAAAGGCGGGAAUGUCUGCGUGCAAGCUCAGGAUCGCU<br>AUUACAAUUCCUCAUGCAGCAAGUGGGCAUGUGUUCCCUGCAGGGUCCGAUCCGGA<br>GGCGGAGGGUCUGGAGGAGGAGGUUCUGGAGGUGGUGGCAGUAGGGUCAUUCCAGU |

SUMMARY OF SEQUENCES

| SEQ ID NO | Description | Sequence |
|---|---|---|
| | | CUCUGGACCUGCAAGGUGUCUUAGCCAGUCCCGAAACCUGCUGAAGACCACAGACG<br>AUAUGGUGAAGACGGCCAGAGAGAAACUGAAACAUUAUUCCUGCACAGCAGAGGAC<br>AUCGAUCAUGAAGAUAUUACACGGGACCAAACCAGCACAUUGAAGACCUGUUUACC<br>ACUGGAACUACACAAGAACGAGAGUUGCCUGGCUACUAGAGAGACUUCUUCCACAA<br>CAAGAGGGAGCUGCCUGCCACCAGAAGACGUCUUUGAUGAUGACCCUGUGCCUU<br>GGUAGCAUCUACGAGGAUCUCAAGAUGUACCAGACAGAGUUCCAGGCCAUCAACGC<br>AGCACUUCAGAAUCACAACCAUCAGCAGAUCAUUUUAGACAAGGGCAUGCUGGUGG<br>CCAUCGAUGAGCUGAUGCAAUCUCUGAAUCAUAAUGGCGAGACACUUCGCCAGAAA<br>CCUCCUGUGGGAGAAGCAGACCCUUACAGAGUGAAGAUGAAGCUCUGCAUCCUGCU<br>UCACGCCUUCAGCACCCGCGUCGUCACUAUUAACAGGGUGAUGGGCUAUCUGAGCU<br>CCGCCUCUGGUGGCGGAUCAGGCGGCGGCGGCUCUGGCGGCGGUGGAAGCGGAGGU<br>GGCGGGUCUGGCGGAGGUUCACUGCAGGUAGUAGUGAUCAGCGCCAUCCUGGCCCU<br>GGUGGUGCUGACCGUGAUCUCAUUGAUCAUCUUGAUUAUGCUGUGGGGCGGAGGAG<br>GCAGCGGGAAACCAAUUCCAAAUCCCCUCCUGGGGUUGGAUAGCACC |
| 270 | mIL12AB-<br>8TM_v5_miR<br>122<br>Nucleotide<br>sequence | AUGUGUCCUCAGAAGCUAACCAUCUCCUGGUUUGCCAUCGUUUUGUUAGUGUCUCC<br>ACUCAUGGCCAUGUGGGAGCUCGAGAAAGACGUUUACGUUGUAGAGGUGGACUGGA<br>CUCCCGACGCCCCAGGCGAAACAGUGAACCUCACCUGUGACACGCCUGAAGAAGAU<br>GACAUCACCUGGACCUCAGACCAGAGACAUGGAGUCAUAGGCUCUGGAAAGACCCU<br>GACCAUCACUGUCAAAGAGUUCCUAGAUGCUGGCCAGUACACCUGCCACAAAGGAG<br>GCGAGACUCUGAGCCACUCACAUCUGCUGCUCCACAAGAAGGAGAAUGGAAUUUGG<br>UCCACAGAAAUUUUAAAGAACUUCAAGAACAAGACUUUCCUGAAGUGUGAAGCACC<br>AAAUUACUCCGGACGGUUCACGUGCUCAUGGCUGGUGCAAAGAAACAUGGACUUGA<br>AGUUCAACAUCAAGAGCAGUAGCAGUUCCCUGACUCUCGGGCAGUGACAUGUGGA<br>AUGGCGUCUCUGUCUGCAGAGAAGGUCACACUGGACCAAAGGGACUAUGAGAAGUA<br>UUCAGUGUCCUGCCAGGAGGAUGUCACCUGCCCAACUGCCGAGGAGACUCUGCCCA<br>UUGAACUGGCGUUGGAAGCACGGCAGCAGAAUAAAUAUGAGAACUACAGCACCAGC<br>UUCUUCAUCAGGGACAUCAUCAAACCAGACCCGCCCAAGAACUUGCAGAUGAAGCC<br>UUUGAAGAACUCACAGGUGGAGGUCAGCUGGGAGUACCCAGACUCCUGGAGCACUC<br>CCCAUUCCUACUUCUCCCUCAAGUUCUUUGUUCGAAUCCAGCGCAAGAAAGAGAAG<br>AUGAAGGAGACAGAGGAGGGGUGUAACCAGAAAGGUGCGUUCCUCGUAGAGAAGAC<br>AUCUACCGAAGUCCAAUGCAAAGGCGGGAAUGUCUGCUGCAAGCUCAGGAUCGCU<br>AUUACAAUUCCUCAUGCAGCAAGUGGGCAUGUGUUCCCUGCAGGGUCCGAUCCGGA<br>GGCGGAGGGAGUGGAGGAGGUGGCUCUGGCGGCGGUGGAAGUAGGGUCAUUCCAGU<br>CUCUGGACCUGCACGCUGUCUUAGCCAGUCCCGAAACCUGCUGAAGACCACAGACG<br>ACAUGGUGAAGACGGCCAGAGAGAAACUGAAACAUUAUUCCUGCACAGCGGAAGAC<br>AUAGAUCACGAGGAUAUCACACGGGACCAAACCAGCACAUUGAAGACCUGUUUACC<br>ACUGGAACUACACAAGAACGAGAGUUGCCUGGCUACUAGAGAGACUUCUUCCACAA<br>CAAGAGGGAGCUGCCUGCCACCAGAAGACGUCUUUGAUGAUGACCCUGUGCCUU<br>GGUAGCAUCUAUGAGGAUCUGAAGAUGUACCAGACAGAGUUCCAGGCCAUCAACGC<br>AGCACUUCAGAAUCACAACCAUCAGCAGAUCAUUUUAGACAAGGGCAUGCUGGUGG<br>CCAUCGAUGAGCUGAUGCAGUCCCUGAAUCAUAAUGGUGAAACGUUGCGCCAGAAA<br>CCUCCUGUGGGAGAAGCAGACCCUUACAGAGUGAAGAUGAAGCUCUGCAUCCUGCU<br>UCACGCCUUCAGCACCCGCGUCGUGACUAUAAACAGGGUGAUGGGCUAUCUGAGCU<br>CCGCCUCUGGUGGCGGAUCAGGAGGAGGUGGAUCGGUGGCGGUGGUUCCGGAGGU<br>GGUGGAUCGGGUGGUGGCUCACUGCAGAUCUACAUCUGGGCCCCGCUGGCCGGCAU<br>CUGCGUGGCCCUGCUGCUGAGCCUGAUCAUCACCCUGAUCUGCUACGGUGGAGGCG<br>GUAGCGGGAAACCAAUUCCAAAUCCCCUCCUGGGGUUGGAUAGCACC |
| 271 | mIL12AB-<br>8OTM-ICD<br>Nucleotide<br>Sequence | AUGUGUCCUCAGAAGCUAACCAUCUCCUGGUUUGCCAUCGUUUUGUUGUGUCUCC<br>ACUCAUGGCCAUGUGGGAGCUCGAGAAAGACGUUUACGUUGUAGAGGUGGACUGGA<br>CUCCCGACGCCCCGGGCGAAACAGUGAACCUCACCUGUGACACGCCUGAAGAAGAU<br>GACAUCACCUGGACCUCAGACCAGAGACAUGGAGUCAUAGGCUCUGGAAAGACCCU<br>GACCAUCACUGUCAAAGAGUUCCUAGAUGCUGGCCAGUACACCUGCCACAAAGGAG<br>GCGAGACUCUGAGCCACUCACAUCUGCUGCUCCACAAGAAGGAGAAUGGAAUUUGG<br>UCCACAGAUCCUGAAGAACUUCAAGAAUAAGACUUUCCUGAAGUGUGAAGCACC<br>AAAUUACUCCGGACGGUUCACGUGCUCAUGGCUGGUGCAAAGAAACAUGGACUUGA<br>AGUUCAACAUCAAGAGCAGUAGCAGUUCCCUGACUCUCGGGCAGUGACAUGUGGA<br>AUGGCGUCUCUGUCUGCAGAGAAGGUCACACUGGACCAAAGGGACUAUGAGAAGUA<br>UUCAGUGUCCUGCCAGGAGGAUGUCACCUGCCCAACUGCCGAGGAGACUCUGCCCA<br>UUGAACUGGCGUUGGAAGCACGGCAGCAGAAUAAAUAUGAGAACUACAGCACCAGC<br>UUCUUCAUCAGGGACAUCAUCAAACCAGACCCGCCCAAGAACUUGCAGAUGAAGCC<br>UUUGAAGAACUCACAGGUGGAGGUCAGCUGGGAGUACCCAGACUCCUGGAGCACUC<br>CCCAUUCCUACUUCUCCCUCAAGUUCUUUGUUCGAAUCCAGCGCAAGAAAGAGAAG<br>AUGAAGGAGACAGAGGAGGGGUGUAACCAGAAAGGUGCGUUCCUCGUAGAGAAGAC<br>AUCUACCGAAGUCCAAUGCAAAGGCGGGAAUGUCUGCUGCAAGCUCAGGAUCGCU<br>AUUACAAUUCCUCAUGCAGCAAGUGGGCAUGUGUUCCCUGCAGGGUCCGAUCCGGA<br>GGCGGAGGGAGCGGUGGUGGAGGCAGCGGAGGAGGUGGAUCAAGGGUCAUUCCAGU<br>CUCUGGACCAGCUAGAUGUCUUAGCCAGUCCCGAAACCUGCUGAAGACCACGGACG<br>ACAUGGUGAAGACGGCCAGAGAGAAACUGAAACAUUAUUCCUGCACCGCAGAGGAU<br>AUCGAUCACGAAGAUAUCACACGGGACCAAACCAGCACAUUGAAGACCUGUUUACC<br>ACUGGAACUACACAAGAACGAGAGUUGCCUGGCUACUAGAGAGACUUCUUCCACAA<br>CAAGAGGGAGCUGCCUGCCACCAGAAGACGUCUUUGAUGAUGACCCUGUGCCUU |

SUMMARY OF SEQUENCES

| SEQ ID NO | Description | Sequence |
|---|---|---|
| | | GGUAGCAUCUAUGAGGACCUCAAGAUGUACCAGACAGAGUUCCAGGCCAUCAACGC AGCACUUCAGAAUCACAACCAUCAGCAGAUCAUUUUAGACAAGGGCAUGCUGGUGG CCAUCGAUGAGCUGAUGCAAUCAUUGAAUCAUAACGGUGAGACAUUGCGCCAGAAA CCUCCUGUGGGAGAAGCAGACCCUUACAGAGUGAAGAUGAAGCUCUGCAUCCUGCU UCACGCCUUCAGCACCCGCGUCGUCACUAUCAACAGGGUGAUGGGCUAUCUGAGCU CCGCCAGCGGUGGCGGAAGCGGUGGAGGCGGCAGCGGCGGUGGUGGUAGCGGCGGC GGCGGCUCCGGCGGAGGGAGCCUGCAGACCCUGGUGCUGUUCGGCGCCGGCUUCGG UGCAGUGAUCACCGUGGUGGUGAUCGUCGUCAUCAUCAAGUGCUUCUGCAAGCACA GAAGCUGCUUCAGAAGAAACGAGGCCAGCAGAGAAACCAACAACAGCCUAACAUUC GGCCCAGAAGAGGCUCUGGCC |
| 272 | IgK-mscIL12AB-80TM-ICD Nucleotide Sequence | AUGGAGACUGACACCCUGCUGCUGUGGGUGCUGUUACUUUGGGUUCCCGGCAGCAC CGGCUACCCCUACGACGUGCCCGACUACGCCAUGUGGGAGCUCGAGAAAGACGUUU ACGUUGUAGAGGUGGACUGGACUCCCGACGCCCGGGCGAAACAGUGAACCUCACC UGUGACACGCCUGAAGAAGAUGACAUCACCUGGACCUCAGACCAGAGACAUGGAGU CAUAGGCUCUGGAAAGACCCUGACCAUCACUGUCAAAGAGUUCUAGAUGCUGGCC AGUACACCUGCCACAAAGGAGGCGAGACUCUGAGCCACUCACAUCUGCUGCUCCAC AAGAAGGAGAAUGGAAUUUGGUCCACUGAGAUCCUGAAGAACUUCAAGAAUAAGAC UUUCCUGAAGUGUGAAGCACCAAAUUACUCCGGACGGUUCACGUGCUCAUGGCUGG UGCAAAGAAACAUGGACUUGAAGUUCAACAUCAAGAGCAGUAGCAGUUCCCUGAC UCUCGGGCAGUGACAUGUGGAAUGGCGUCUCUGUCUGCAGAGAAGGUCACACUGGA CCAAAGGGACUAUGAGAAGUAUUCAGUGUCCUGCCAGGAGGAUGUCACCUGCCCAA CUGCCGAGGAGACACUGCCCAUUGAACUGGCGUUGGAAGCACGGCAGCAGAAUAAA UAUGAGAACUACAGCACCAGCUUCUUCAUCAGGGACAUCAUCAAACCAGACCCGCC CAAGAACUUGCAGAUGAAGCCUUUGAAGAACUCACAGGUGGAGGUCAGCUGGGAGU ACCCGGACUCCUGGAGCACUCCCCAUUCCUACUUCUCCCUCAAGUUCUUUGUUCGA AUCCAGCGCAAGAAAGAGAAGAUGAAGGAGACAGAGGAGGGGUGUAACCAGAAAGG UGCGUUCCUCGUAGAGAAGACAUCUACCGAAGUCCAAUGCAAAGGCGGGAAUGUCU GCGUGCAAGCUCAGGAUCGCUAUUACAAUUCCAUGCAGCAAGUGGGCAUGUGUU CCCUGCAGGGUCCGAGGAAGCACCAGCGGUUCCGGCAAACCAGGUAGCGGAGAGGG CAGCACCAAGGGCAGGGUCAUUCCAGUCUCUGGACCAGCUAGAUGUCUUAGCCAGU CCCGAAACCUGCUGAAGACCACGGACGACAUGGUGAAGACGGCCAGAGAGAAACUG AAACAUUAUUCCUGCACCGCAGAGGAUAUCGAUCACGAAGAUAUCACACGGGACCA AACCAGCACAUUGAAGACCUGUUUACCACUGGAACUACACAAGAACGAGAGUUGCC UGGCUACUAGAGAGACUUCUUCCACAACAAGAGGGAGCUGCCUGCCACCACAGAAG ACGUCUUUGAUGAUGACCCUGUGCCUUGGUAGCAUCUAUGAGGACCUCAAGAUGUA CCAGACAGAGUUCCAGGCCAUCAACGCAGCACUUCAGAAUCACAACCAUCAGCAGA UCAUUUUAGACAAGGGCAUGCUGGUGGCCAUCGAUGAGCUGAUGCAAUCAUUGAAU CAUAACGGUGAGACAUUGCGCCAGAAACCUCCUGUGGGAGAAGCAGACCCUUACAG AGUGAAGAUGAAGCUCUGCAUCCUGCUUCACGCCUUCAGCACCCGCGUCGUCACUA UCAACAGGGUGAUGGGCUAUCUGAGCUCCGCCACCCUGGUGCUGUUCGGCGCCGGC UUCGGUGCAGUGAUCACCGUGGUGGUGAUCGUCGUCAUCAUCAAGUGCUUUUGCAA GCACAGAAGCUGUUUCAGAAGAAACGAGGCCAGCAGAGAAACCAACAACUCCCUGA CUUUCGGGCCCGAGGAAGCCCUCGCC |
| 273 | hIL12AB-8TM-Nucleotide Sequence | AUGUGCCACCAGCAGCUGGUGAUCAGCUGGUUCAGCCUGGUGUUCCUGGCCAGCCC CCUGGUGGCCAUCUGGGAGCUGAAGAAGGACGUGUACGUGGUGGAGUUGGAUUGGU ACCCCGACGCCCCCGGCGAGAUGGUGGUGCUGACCUGCGACACCCCCGAGGAGGAC GGCAUCACCUGGACCCUGGACCAGAGCAGCGAGGUGCUGGGCAGCGGCAAGACCCU GACCAUCCAGGUGAAGGAGUUCGGCGACGCCGGCCAGUACACCUGCCACAAGGGCG GCGAGGUGCUGAGCCACAGCCUGCUGCUGCUGCACAAGAAGGAGGACGGCAUCUGG AGCACCGACAUCCUGAAGGACCAGAAGGAGCCCAAGAACAAGACCUUCCUGAGAUG CGAGGCCAAGAACUACAGCGGCAGAUUCACCUGCUGGUGGCUGACCACCAUCAGCA CCGACCUGACCUUCAGCGUGAAGAGCAGCAGGGCAGCAGCGACCCCCAGGGCGUG ACCUGCGGCGCCGCCACCCUGAGCGCCGAGAGAGUGAGAGGCGACAACAAGGAGUA CGAGUACAGCGUGGAGUGCCAGGAAGAUAGCGCCUGCCCCGCCGCCGAGGAGAGCC UGCCCAUCGAGGUGAUGGUGGACGCCGUGCACAAGCUGAAGUACGAGAACUACACC AGCAGCUUCUUCAUCAGAGAUAUCAUCAAGCCCGACCCCCCCAAGAACCUGCAGCU GAAGCCCCUGAAGAACAGCCGGCAGGUGGAGGUGAGCUGGGAGUACCCCGACACCU GGAGCACCCCCCACAGCUACUUCAGCCUGACCUUCUGCGUGCAGGUGCAGGGCAAG AGCAAGAGAGAGAAGAAAGAUAGAGUGUUCACCGACAAGACCAGCGCCACCGUGAU CUGCAGAAAGAACGCCAGCAUCAGCGUGAGAGCCCAAGAUAGAUACUACAGCAGCA GCUGGAGCGAGUGGGCCAGCGUGCCCUGCAGCGGCGGCGGCGGCGGCAGCAGA AACCUGCCCGUGGCCACCCCCGACCCCGGCAUGUUCCCCUGCCUGCACCACAGCCA GAACCUGCUGAGAGCCGUGAGCAACAUGCUGCAGAAGGCCCGGCAGACCCUGGAGU UCUACCCCUGCACCAGCGAGGAGAUCGACCACGAAGAUAUCACCAAAGAUAAGACC AGCACCGUGGAGGCCUGCCUGCCCCUGGAGCUGACCAAGAACGAGAGCUGCCUGAA CAGCAGAGAGACCAGCUUCAUCACCAACGGCAGCUGCCUGGCCAGCAGAAAGACCA GCUUCAUGAUGGCCCUGUGCCUGAGCAGCAUCUACGAGGACCUGAAGAUGUACCAG GUGGAGUUCAAGACCAUGAACGCCAAGCUGCUGAUGGACCCCAAGCGGCAGAUCUU CCUGGACCAGAACAUGCUGGCCGUGAUCGACGAGCUGAUGCAGGCCCUGAACUUCA ACAGCGAGACCGUGCCCCAGAAGAGCAGCCUGGAGGAGCCCGACUUCUACAAGACC AAGAUCAAGCUGUGCAUCCUGCUGCACGCCUUCAGAAUCAGAGCCGUGACCAUCGA |

SUMMARY OF SEQUENCES

| SEQ ID NO | Description | Sequence |
|---|---|---|
| | | CAGAGUGAUGAGCUACCUGAACGCCAGCUCUGGUGGCGGAUCAGGCGGCGGCGGUU<br>CAGGAGGCGGUGGAAGUGGAGGUGGCGGGUCUGGCGGAGGUUCACUGCAGAUCUAC<br>AUCUGGGCUCCACUGGCCGGCACCUGCGGCGUGCUGCUGAGCCUGGUGAUCAC<br>CCUGUACUGCUACGGGAAACCAAUUCCAAAUCCCCUCCUGGGGUUGGAUAGCACC |
| 274 | hIL12AB-8TM no epitope tag Nucleotide Sequence | AUGUGCCACCAGCAGCUGGUGAUCAGCUGGUUCAGCCUGGUGUUCCUGGCCAGCCC<br>CCUGGUGGCCAUCUGGGAGCUGAAGAAGGACGUGUACGUGGUGGAGUUGGAUUGGU<br>ACCCCGACGCCCCCGGCGAGAUGGUGGUGCUGACCUGCGACACCCCCGAGGAGGAC<br>GGCAUCACCUGGACCCUGGACCAGAGCAGCGAGGUGCUGGGCAGCGGCAAGACCCU<br>GACCAUCCAGGUGAAGGAGUUCGGCGACGCCGGCCAGUACACCUGCCACAAGGGCG<br>GCGAGGUGCUGAGCCACAGCCUGCUGCUGCUGCACAAGAAGGAGGACGGCAUCUGG<br>AGCACCGACAUCCUGAAGGACCAGAAGGAGCCCAAGAACAAGACCUUCCUGAGAUG<br>CGAGGCCAAGAACUACAGCGGCAGAUUCACCUGCUGGUGGCUGACCACCAUCAGCA<br>CCGACCUGACCUUCAGCGUGAAGAGCAGCAGAGGCAGCAGCGACCCCCAGGGCGUG<br>ACCUGCGGCGCCGCCACCCUGAGCGCCGAGAGAGUGAGAGGCGACAACAAGGAGUA<br>CGAGUACAGCGUGGAGUGCCAGGAAGAUAGCGCCUGCCCCGCCGCCGAGGAGAGCC<br>UGCCCAUCGAGGUGAUGGUGGACGCCGUGCACAAGCUGAAGUACGAGAACUACACC<br>AGCAGCUUCUUCAUCAGAGAUAUCAUCAAGCCCGACCCCCCCAAGAACCUGCAGCU<br>GAAGCCCCUGAAGAACAGCCGGCAGGUGGAGGUGAGCUGGGAGUACCCCGACACCU<br>GGAGCACCCCCACAGCUACUUCAGCCUGACCUUCUGCGUGCAGGUGCAGGGCAAG<br>AGCAAGAGAGAGAAGAAAGAUAGAGUGUUCACCGACAAGACCAGCGCCACCGUGAU<br>CUGCAGAAAGAACGCCAGCAUCAGCGUGAGAGCCCAAGAUAGAUACUACAGCAGCA<br>GCUGGAGCGAGUGGGCCAGCGUGCCCUGCAGCGGCGGCGGCGGCGGCAGCAGA<br>AACCUGCCCGUGGCCACCCCCGACCCCGGCAUGUUCCCCUGCCUGCACCACAGCCA<br>GAACCUGCUGAGAGCCGUGAGCAACAUGCUGCAGAAGGCCCGGCAGACCCUGGAGU<br>UCUACCCCUGCACCAGCGAGGAGAUCGACCACGAAGAUAUCACCAAAGAUAAGACC<br>AGCACCGUGGAGGCCUGCCUGCCCCUGGAGCUGACCAAGAACGAGAGCUGCCUGAA<br>CAGCAGAGAGACCAGCUUCAUCACCAACGGCAGCUGCCUGGCCAGCAGAAAGACCA<br>GCUUCAUGAUGGCCCUGUGCCUGAGCAGCAUCUACGAGGACCUGAAGAUGUACCAG<br>GUGGAGUUCAAGACCAUGAACGCCAAGCUGCUGAUGGACCCCAAGCGGCAGAUCUU<br>CCUGGACCAGAACAUGCUGGCCGUGAUCGACGAGCUGAUGCAGGCCCUGAACUUCA<br>ACAGCGAGACCGUGCCCCAGAAGAGCAGCCUGGAGGAGCCCGACUUCUACAAGACC<br>AAGAUCAAGCUGUGCAUCCUGCUGCACGCCUUCAGAAUCAGAGCCGUGACCAUCGA<br>CAGAGUGAUGAGCUACCUGAACGCCAGCUCUGGUGGCGGAUCAGGCGGCGGCGGUU<br>CAGGAGGCGGUGGAAGUGGAGGUGGCGGGUCUGGCGGAGGUUCACUGCAGAUCUAC<br>AUCUGGGCUCCACUGGCCGGCACCUGCGGCGUGCUGCUGCUGAGCCUGGUGAUCAC<br>CCUGUACUGCUAC |
| 275 | h12AB-8OTID Nucleotide Sequence 1 matched | AUGUGCCACCAGCAGCUGGUGAUCAGCUGGUUCAGCCUGGUGUUCCUGGCCAGCCC<br>CCUGGUGGCCAUCUGGGAGCUGAAGAAGGACGUGUACGUGGUGGAGUUGGAUUGGU<br>ACCCCGACGCCCCCGGCGAGAUGGUGGUGCUGACCUGCGACACCCCCGAGGAGGAC<br>GGCAUCACCUGGACCCUGGACCAGAGCAGCGAGGUGCUGGGCAGCGGCAAGACCCU<br>GACCAUCCAGGUGAAGGAGUUCGGCGACGCCGGCCAGUACACCUGCCACAAGGGCG<br>GCGAGGUGCUGAGCCACAGCCUGCUGCUGCUGCACAAGAAGGAGGACGGCAUCUGG<br>AGCACCGACAUCCUGAAGGACCAGAAGGAGCCCAAGAACAAGACCUUCCUGAGAUG<br>CGAGGCCAAGAACUACAGCGGCAGAUUCACCUGCUGGUGGCUGACCACCAUCAGCA<br>CCGACCUGACCUUCAGCGUGAAGAGCAGCAGAGGCAGCAGCGACCCCCAGGGCGUG<br>ACCUGCGGCGCCGCCACCCUGAGCGCCGAGAGAGUGAGAGGCGACAACAAGGAGUA<br>CGAGUACAGCGUGGAGUGCCAGGAAGAUAGCGCCUGCCCCGCCGCCGAGGAGAGCC<br>UGCCCAUCGAGGUGAUGGUGGACGCCGUGCACAAGCUGAAGUACGAGAACUACACC<br>AGCAGCUUCUUCAUCAGAGAUAUCAUCAAGCCCGACCCCCCCAAGAACCUGCAGCU<br>GAAGCCCCUGAAGAACAGCCGGCAGGUGGAGGUGAGCUGGGAGUACCCCGACACCU<br>GGAGCACCCCCACAGCUACUUCAGCCUGACCUUCUGCGUGCAGGUGCAGGGCAAG<br>AGCAAGAGAGAGAAGAAAGAUAGAGUGUUCACCGACAAGACCAGCGCCACCGUGAU<br>CUGCAGAAAGAACGCCAGCAUCAGCGUGAGAGCCCAAGAUAGAUACUACAGCAGCA<br>GCUGGAGCGAGUGGGCCAGCGUGCCCUGCAGCGGCGGCGGCGGCGGCAGCAGA<br>AACCUGCCCGUGGCCACCCCCGACCCCGGCAUGUUCCCCUGCCUGCACCACAGCCA<br>GAACCUGCUGAGAGCCGUGAGCAACAUGCUGCAGAAGGCCCGGCAGACCCUGGAGU<br>UCUACCCCUGCACCAGCGAGGAGAUCGACCACGAAGAUAUCACCAAAGAUAAGACC<br>AGCACCGUGGAGGCCUGCCUGCCCCUGGAGCUGACCAAGAACGAGAGCUGCCUGAA<br>CAGCAGAGAGACCAGCUUCAUCACCAACGGCAGCUGCCUGGCCAGCAGAAAGACCA<br>GCUUCAUGAUGGCCCUGUGCCUGAGCAGCAUCUACGAGGACCUGAAGAUGUACCAG<br>GUGGAGUUCAAGACCAUGAACGCCAAGCUGCUGAUGGACCCCAAGCGGCAGAUCUU<br>CCUGGACCAGAACAUGCUGGCCGUGAUCGACGAGCUGAUGCAGGCCCUGAACUUCA<br>ACAGCGAGACCGUGCCCCAGAAGAGCAGCCUGGAGGAGCCCGACUUCUACAAGACC<br>AAGAUCAAGCUGUGCAUCCUGCUGCACGCCUUCAGAAUCAGAGCCGUGACCAUCGA<br>CAGAGUGAUGAGCUACCUGAACGCCAGCUCUGGUGGCGGAUCAGGCGGCGGCGGUU<br>CAGGAGGCGGUGGAAGUGGAGGUGGCGGGUCUGGCGGAGGUUCACUGCAGCUGCU<br>CCCAGCUGGGCCAUCACCCUGAUCAGCGUGAACGGCAUCUUCGUGAUCUGCUGCCU<br>GACCUACUGCUUCGCCCCUCGAUGCAGAGAGAAGAAGAAACGAGAGACUGAA<br>GAGAGAGCGUGCGACCCGUG |

| SEQ ID NO | Description | Sequence |
|---|---|---|
| 276 | h12AB-80TID Nucleotide Sequence 2 SE_IL12_041 | AUGUGCCACCAGCAGCUGGUGAUCAGCUGGUUCAGCCUGGUGUUCCUGGCCAGCCC UCUGGUGGCCAUCUGGGAGCUGAAGAAGGACGUGUACGUGGUGGAGCUGGACUGGU ACCCUGACGCCCCUGGCGAGAUGGUGGUGCUGACCUGCGACACCCCUGAGGAGGAC GGCAUCACCUGGACCCUGGACCAGAGCAGCGAGGUGCUGGGCAGCGGCAAGACCCU GACCAUCCAGGUGAAGGAGUUCGGCGACGCCGGCCAGUACACCUGCCACAAGGGCG GAGAGGUGUUAAGCCACAGCCUGCUCUUGCUACACAAGAAGGAGGACGGUAUUUGG AGCACCGACAUCCUGAAGGACCAGAAGGAGCCUAAGAACAAGACCUUCCUGAGGUG CGAGGCCAAGAACUACAGCGGCAGAUUCACCUGCUGGUGGCUGACCACCAUCUCCA CGGACCUGACCUUCAGCGUUAAGAGUAGCAGAGGCAGCAGCGACCCUCAGGGCGUG ACUUGUGGCGCCGCCACCCUGAGCGCCGAGAGUGAGAGGCGACAACAAGGAGUA CGAGUACAGCGUGGAGUGCCAGGAGGACAGCGCCUGCCCUGCCGCCGAGGAGAGC UGCCUAUCGAGGUGAUGGUGGACGCCGUGCACAAGCUGAAGUACGAGAAUUACACC UCAUCCUUCUUCAUCAGAGACAUCAUCAAGCCUGACCCUCCAAAGAAUCUGCAGCU GAAGCCUCUGAAGAACAGCAGACAGGUGGAGGUGAGCUGGGAGUAUCCGGAUACCU GGAGCACACCUCACAGCUACUUCUCACUUACAUUCUGCGUGCAGGUGCAGGGCAAG AGCAAGAGAGAAGAAGGAUAGAGUGUUCACCGACAAGACCAGCGCCACCGUGAU CUGCAGAAAGAACGCCAGCAUCUCAGUGAGAGCCCAGGACAGAUACUACUCAUCCU CCUGGAGCGAGUGGGCCAGCGUGCCUUGCUCCGGUGGUGGUGGCGGAGGCAGCAGA AACCUGCCUGUGGCUACACCUGAUCCUGGCAUGUUCCCUUGCCUGCACCACAGCCA GAACCUGCUGAGAGCCGUGAGCAACAUGCUGCAGAAGGCCAGACAGACUCUGGAGU UCUACCCUUGCACCAGCGAGGAGAUCGACCACGAGGACAUCACCAAGGAUAAGACA AGCACCGUGGAGGCCUGCCUGCCUCUGGAGCUGACCAAGAACGAGAGCUGCCUAAA CUCUAGGGAAACCAGCUUCAUUACUAACGGCAGUUGCUUAGCCAGCCGGAAGACAU CGUUCAUGAUGGCCCUGUGCCUGAGCAGCAUCUACGAGGACCUGAAGAUGUACCAA GUGGAGUUCAAGACCAUGAACGCCAAGCUGCUGAUGGACCCUAAGAGACAGAUCUU CCUAGACCAGAACAUGCUCGCCGUGAUCGACGAGCUGAUGCAGGCCCUGAACUUCA ACAGCGAAACUGUGCCUCAGAAGAGUUCACUGGAGGAGCCUGACUUCUAUAAGACU AAGAUCAAGCUGUGUAUUCUCCUCCACGCCUUCAGAAUCAGGGCUGUCACCAUCGA UAGGGUGAUGAGCUACCUGAACGCAUCGUCCGGCGGAGGAUCCGGAGGAGGAGGCU CCGGCGGUGGUGGAAGUGGAGGAGGUGGAUCAGGAGGCGGUAGUCUCCAGCUCCUG CCUAGCUGGGCCAUCACCCUGAUCUCUGUAAACGGCAUUUUCGUCAUUUGCUGUCU GACUUACUGCUUCGCCCCUAGGUGCCGGGAGCGUAGGAGAAACGAGAGACUGCGCC GGGAGUCCGUGCGGCCUGUG |
| 277 | h12AB-80TID Nucleotide Sequence 3 SE_IL12_042 | AUGUGUCACCAGCAGCUCGUGAUCAGCUGGUUCAGCCUGGUGUUCCUGGCCUCCCC GCUGGUGGCCAUCUGGGAGCUGAAGAAGGACGUGUACGUGGUGGAGCUGGACUGGU ACCCCGACGCUCCCGGCGAGAUGGUGGUGCUGACCUGCGACACCACCGGAGGAAGAC GGAUCACCUGGACCCUGGACCAAUCCUCCGAAGUUCUGGGCAGCGGCAAGACCCU GACCAUCCAGGUGAAGGAGUUCGGCGACGCCGGCCAGUACACCUGCCACAAGGGCG GCGAGGUGCUGAGCCACAGCCUGCUCCUCCUCCACAAGAAAGAGGACGGCAUCUGG AGCACCGACAUCCUGAAGGACCAGAAGGAGCCCAAGAACAAGACCUUCCUGCGGUG CGAGGCCAAGAACUACUCAGGCCGAUUCACCUGUUGGUGGCUCACAACUAUCAGCA CAGACCUGACCUUCAGCGUGAAGUCUAGCCGGGGCAGCAGCGAUCCUCAGGGCGUG ACCUGCGGCGCCGCCACCCUGAGCGCCGAGCGGGUGCGGGGCGACAACAAGGAGUA CGAGUACAGCGUGGAGUGCCAGGAGGACAGCGCCUGCCCCGGCCGCCGAAGAGUCCC UGCCCAUCGAGGUGAUGGUGGACGCCGUGCACAAACUCAAGUACGAGAACUACACC UCCAGCUUCUUCAUCCGGGACAUCAUCAAGCCCGAUCCGCCCAAGAACCUGCAGCU GAAGCCCCUGAAGAACAGCCGGCAGGUGGAGGUGAGCUGGGAAUACCCGGACACGU GGUCCACCCCACACAGCUACUUCAGCCUGACCUUUUGCGUGCAGGUCCAAGGCAAG AGCAAGCGGGAGAAGAAGGACCGGGUGUUCACCGAUAAGACCUCAGCCACCGUGAU UUGCAGAAAGAACGCAUCCAUAUCCGUACGCGCCCAGGAUCGGUACUACAGCAGCA GCUGGAGCGAGUGGGCCAGCGUGCCCUGUAGCGGCGGCGGCGGUGGUGGGAGUCGC AACCUGCCCGUGGCCACCCCGGACCCCGGCAUGUUCCCCUGCCUGCACCACAGCCA GAACCUGCUGCGGGCCGUGAGCAACAUGCUGCAGAAGGCCCGGCAGACCCUGGAGU UCUACCCCUGCACCAGCGAGGAGAUCGACCACGAGGACAUCACCAAGGACAAGACC AGCACCGUGGAGGCCUGCCUGCCCCUGGAGCUGACCAAGAACGAGAGCUGCCUGAA CAGUCGCGAAACCUCCUUCAUUACGAACGGCAGCUGCCUGGCCAGCCGGAAGACCA GCUUCAUGAUGGCCCUGUGCCUGAGCAGCAUCUACGAGGACCUGAAGAUGUACCAG GUGGAGUUCAAGACCAUGAACGCCAAGCUGCUGAUGGACCCCAAGCGGCAGAUCUU CCUGGACCAGAACAUGCUGGCCGUGAUCGACGAGCUGAUGCAGGCCCUGAACUUCA ACAGCGAAACCGUGCCCCAGAAGUCCAGCCUGGAGGAGCCCGACUUCUACAAGACC AAGAUCAAGCUGUGCAUCCUGCUGCACGCCUUCCGGAUCCGGGCCGUGACCAUCGA CCGGGUGAUGAGCUACCUGAACGCCUCUUCCGGUGGCGGGAGCGGAGGCGGUGGAU CUGGCGGAGGAGGUCGGAGGCGGCGGAAGCGGUGGUGGAAGCCUUCAACUGCUG CCCUCGUGGCCAUCACACUGAUCUCCGUGAACGGCAUCUUCGUGAUCUGCUGCCU GACCUACUGCUUCGCCCCUCGGUGCCGCGAGCGACGGAGAAACGAGAGGCUCAGAC GGGAGAGCGUGCGGCCCGUG |
| 278 | h12AB-80TID Nucleotide Sequence 4 SE_IL12_043 | AUGUGCCACCAACAGCUGGUGAUCAGCUGGUUCAGCCUGGUGUUCCUGGCCUCACC CCUGGUGGCCAUCUGGGAGCUGAAGAAGGACGUGUACGUGGUGGAGCUGGACUGGU ACCCCGACGCCCCUGGCGAGAUGGUGGUGCUGACCUGCGACACGCCCGAGGAAGAC GGAUCACCUGGACUCUGGACCAGAGCAGCGAGGUGCUGGGCAGCGGCAAGACCCU GACCAUCCAGGUGAAGGAGUUCGGCGACGCCGGCCAGUACACCUGCCACAAGGGCG |

| SEQ ID NO | Description | Sequence |
|---|---|---|
| | | GCGAAGUGCUGAGCCACAGCCUUCUGCUGCUGCACAAGAAGGAGGACGGCAUUUGG AGCACCGACAUCCUGAAGGACCAGAAGGAGCCCAAGAACAAGACCUUCCUGCGGUG CGAGGCCAAGAACUACAGCGGCCGGUUCACCUGCUGGUGGCUGACCACCAUCAGCA CCGACCUUACCUUCAGCGUUAAGAGCAGCCGGGCAGCAGCGAUCCCCAGGGCGUG ACCUGCGGAGCCGCCACCCUCUCCGCAGAGCGGGUGCGUGGCGACAACAAGGAGUA CGAGUACAGCGUGGAGUGCCAGGAGGAUAGCGCCUGUCCCGCUGCCGAAGAGAGCC UGCCCAUCGAGGUGAUGGUGGACGCCGUGCACAAGCUGAAGUACGAGAACUACACC AGCAGCUUCUUCAUCCGGGACAUCAUCAAGCCCGAUCCACCCAAGAACCUGCAGCU GAAGCCCCUGAAGAACAGCAGGCAGGUUGAGGUGAGCUGGGAAUACCCCGACACCU GGAGCACCCCUCACAGCUACUUCAGCCUGACCUUCUGCGUGCAGGUGCAGGGCAAG AGCAAGCGGGAGAAGAAGGAUCGGGUGUUCACCGAUAAGACCAGCGCCACCGUGAU CUGCCGGAAGAACGCCAGCAUCAGCGUUCGGGCCCAGGACCGGUACUACAGCAGCA GCUGGAGCGAGUGGGCCAGCGUGCCCUGCUCUGGAGGCGGAGGCGGAGGCUCACGG AACCUGCCAGUGGCCACGCCGGAUCCCGGCAUGUUCCCCUGCCUGCACCACAGCCA GAACCUGCUGCGGGCCGUGAGCAACAUGCUGCAGAAGGCCCGGCAGACCCUGGAGU UCUACCCCUGCACCAGCGAGGAGAUCGACCACGAGGACAUCACCAAGGACAAGACC AGCACCGUGGAGGCCUGCCUGCCCCUGGAGCUGACCAAGAACGAGAGCUGCCUGAA CAGCCGGGAGACAAGCUUCAUCACCAACGGCAGCUGCCUGGCCAGCCGGAAGACCA GCUUCAUGAUGGCCCUGUGCCUGAGCAGCAUCUACGAGGACCUGAAGAUGUACCAG GUGGAGUUCAAGACCAUGAACGCCAAGCUGCUGAUGGACCCCAAGCGGCAGAUCUU CCUGGAUCAGAACAUGCUGGCCGUGAUCGACGAGCUGAUGCAGGCCCUGAACUUCA ACAGCGAGACUGUGCCCCAGAAGUCCAGCCUGGAGGAGCCCGACUUCUACAAGACC AAGAUCAAGCUGUGCAUCCUGCUGCACGCCUUCCGGAUCCGGGCUGUGACCAUCGA CCGGGUGAUGAGCUACCUGAACGCCUCUUCCGGCGGCGGAUCGGGAGGUGGAGGUU CUGGAGGAGGUGGAAGCGGUGGUGGCGGAAGCGGCCGGUGGCAGCCUGCAAUUGCUC CCCAGCUGGGCCAUCACCCUGAUCAGCGUGAACGGCAUCUUCGUGAUCUGUUGCCU GACCUACUGCUUCGCCCCACGGUGCCGGGAGAGACGGCGGAACGAGCGGCUGCGGC GAGAGAGCGUGCGGCCCGUG |
| 279 | h12AB-80TID Nucleotide Sequence 5 SE_IL12_044 | AUGUGUCACCAGCAGUUGGUGAUAUCUUGGUUCUCACUGGUGUUUCUUGCAUCACC ACUCGUGGCGAUCUGGGAACUUAAGAAGGACGUCUACGUGGUGGAGUUAGAUUGGU AUCCUGACGCACCCGGGGAAAUGGUUGUCCUCACGUGCGACACUCCAGAGGAAGAC GGGAUCACCUGGACCCUGGAUCAGUCGUCGAGGGUACUUGGCAGUGGCAAGACACU GACAAUCCAGGUUAAAGAGUUUGGUGACGCCGGGCAGUAUACGUGCCACAAGGGCG GCGAGGUGUUGUCACAUUCUCUGCUUUCUCCUGCACAAGAAAGAAGACGGCAUCUGG UCAACUGACAUCCUGAAAGACCAGAAAGAACCCAAGAAUAAGACCUUCCUCCGGUUG CGAAGCAAAGAACUACUCAGGGCGUUUCACUUGCUGGUGGCUAACCACAAUUUCUA CCGAUCUGACGUUCUCUGUGAAGUCAAGUAGGGGAUCCUCAGACCCUCAAGGGGUC ACCUGCGGCGCCGCCACCCUUAUCCGCCGAAAGAGUUCGGGGUGACAAUAAAGAGUA CGAGUACAGCGUCGAGUGUCAGGAGGACUCCGCCUGUCCUGCUGCAGAGGAGUCCC UGCCGAUCGAAGUUAUGGUGGACGCCGUCCACAAGCUCAAAUACGAGAACUACACC UCAAGCUUCUUCAUCAGAGACAUCAUCAAGCCUGAUCCACCCAAGAACCUGCAACU GAAGCCUUUGAAGAACAGCCGACAGGUGGAGGUUUCUUGGGAAUAUCCAGACACGU GGAGUACGCCCCAUUCCUACUUCAGCUUGACCUUCUGCGUGCAGGUUCAGGGGAAG UCCAAGAGAGAGAAGAAGGAUCGUGUGUUCACAGACAAGACCUCCGCCACCGUGAU CUGCCGGAAGAACGCAUCUAUCAGUGUUAGGGCCCAGGAUCGGUACUACUCGAGUU CCUGGUCUGAGUGGGCAAGUGUGCCCUGCUCCGGUGGCGGCGGAGGAGGGUCAAGG AACCUGCCCGUUGCCACACCAGAUCCAGGAAUGUUCCCCUGUCUGCACCACUCUCA GAACCUUUUGCGAGCCGUUUCUAAUAUGCUUCAGAAGGCUCGGCAGACCCUUGAGU UUUAUCCCUGCACGUCUGAGGAGAUCGAUCACGAGGACAUCACCAAGGACAAGACU UCCACCGUUGAAGCCUGUUUACCUCUGGAACUGACCAAGAACGAAUCCUGUCUCAA CAGUAGGGAAACGAGCUUCAUCACUAACGGAAGCUGUCUGGCUAGCCGGAAGACCU CUUUUAUGAUGGCCCUGUGCCUUGAGCUCUAUUUACGAAGAUUUGAAGAUGUACCAA GUGGAAUUUAAGACUAUGAACGCCAAACUGCUGAUGGACCCUAAGCGCCAAAUCUU CUUGGAUCAGAAUAUGCUGGCUGUAAUCGACGAGCUCAUGCAGGCUCUGAACUUCA ACAGCGAGACGGUACCGCAGAAGAGUUCCCUGGAAGAACCGGACUUCUACAAGACU AAGAUUAAACUCUGCAUACUCCUCCACGCCUUCCGGAUCAGGGCCGUCACAAUAGA UAGGGUCAUGAGUUAUCUUAACGCGAGUUCGGUGGUGGAUCGGGUGGCGGAGGCU CAGGAGGAGGCGGUUCGGCGGUGGUGGGAGUGGAGGCGGUAGUCUGCAGCUGCUG CCGAGUUGGGCAAUCACGCUAAUCAGCGUGAACGGAAUAUUCGUAAUUUGUUGCCU CACCUAUUGUUUCGCACCCAGGUGCAGGGAAAGGAGGCGAAACGAAAGGUUGAGGA GGGAAUCUGUCCGGCCAGUG |
| 280 | Human PGFRB G739tr intracellular domain nucleotide sequence | CAGAAGAAGCCCAGAUACGAGAUCCGGUGGAAGGUGAUCGAGAGCGUGAGCAGCGA CGGCCACGAGUUCAUCUUCGUGGACCCCAUGCAGCUGCCCUACGACAGCACCUGGG AGCUGCCCCGUGAUCAGCUGGUGCUGGGCAGAACCCUGGGCAGCGGCGCCUUCGGC CAGGUGGUGGAGGCUACCGCCAUGGGCAUCAGCAAGCCAGGCACCAUGAAGGU GGCCGUGGCCAUGCUCAAGAGCACCGCCAGAAGCAGCGAGAAGCAGGCCCUGAUGA GCGAGCUGAAGAUCAUGAGCCAUCUGGGGCCCCACCUGAACGUGGUGAACCUGCUG GGCGCCUGCACCAAGGGCGGCCCCAUCUACAUCAUCACCGAGUACUGCAGAUACGG CGACCUGGUGGACUACCUGCACAGAAACAAGCACACCUUCCUGCAGCACCACAGCG ACAAGAGAAGACCCUCCAGCGCCGAGCUGUACAGCAACGCCCUGCCCGUUGGUCUG CCCCUACCCAGCCACGUGAGCCUGACCGGCGAGAGCGACGGCGGC |

SUMMARY OF SEQUENCES

| SEQ ID NO | Description | Sequence |
|---|---|---|
| 281 | h12AB-PTM-ICD-E570tr Nucleotide Sequence | AUGUGCCACCAGCAGCUGGUGAUCAGCUGGUUCAGCCUGGUGUUCCUGGCCAGCCC<br>CCUGGUGGCCAUCUGGGAGCUGAAGAAGGACGUGUACGUGGUGGAGUUGGAUUGGU<br>ACCCCGACGCCCCCGGCGAGAUGGUGGUGCUGACCUGCGACACCCCCGAGGAGGAC<br>GGCAUCACCUGGACCCUGGACCAGAGCAGCGAGGUGCUGGGCAGCGGCAAGACCCU<br>GACCAUCCAGGUGAAGGAGUUCGGCGACGCCGGCCAGUACACCUGCCACAAGGGCG<br>GCGAGGUGCUGAGCCACAGCCUGCUGCUGCUGCACAAGAAGGAGGACGGCAUCUGG<br>AGCACCGACAUCCUGAAGGACCAGAAGGAGCCCAAGAACAAGACCUUCCUGAGAUG<br>CGAGGCCAAGAACUACAGCGGCAGAUUCACCUGCUGGUGGCUGACCACCAUCAGCA<br>CCGACCUGACCUUCAGCGUGAAGAGCAGCAGAGGCAGCAGCGACCCCCAGGGCGUG<br>ACCUGCGGCGCCGCCACCCUGAGCGCCGAGAGAGUGAGAGGCGACAACAAGGAGUA<br>CGAGUACAGCGUGGAGUGCCAGGAAGAUAGCGCCUGCCCCGCCGCCGAGGAGAGCC<br>UGCCCAUCGAGGUGAUGGUGGACGCCGUGCACAAGCUGAAGUACGAGAACUACACC<br>AGCAGCUUCUUCAUCAGAGAUAUCAUCAAGCCCGACCCCCCCAAGAACCUGCAGCU<br>GAAGCCCCUGAAGAACAGCCGGCAGGUGGAGGUGAGCUGGGAGUACCCCGACACCU<br>GGAGCACCCCCACAGCUACUUCAGCCUGACCUUCUGCGUGCAGGUGCAGGGCAAG<br>AGCAAGAGAGAGAAGAAAGAUAGAGUGUUCACCGACAAGACCAGCGCCACCGUGAU<br>CUGCAGAAAGAACGCCAGCAUCAGCGUGAGAGCCCAAGAUAGAUACUACAGCAGCA<br>GCUGGAGCGAGUGGGCCAGCGUGCCCUGCAGCGGCGGCGGCGGCGGCAGCAGA<br>AACCUGCCCGUGGCCACCCCCGACCCCGGCAUGUUCCCCUGCCUGCACCACAGCCA<br>GAACCUGCUGAGAGCCGUGAGCAACAUGCUGCAGAAGGCCCGGCAGACCCUGGAGU<br>UCUACCCCUGCACCAGCGAGGAGAUCGACCACGAAGAUAUCACCAAAGAUAAGACC<br>AGCACCGUGGAGGCCUGCCUGCCCCUGGAGCUGACCAAGAACGAGAGCUGCCUGAA<br>CAGCAGAGAGACCAGCUUCAUCACCAACGGCAGCUGCCUGGCCAGCAGAAAGACCA<br>GCUUCAUGAUGGCCCUGUGCCUGAGCAGCAUCUACGAGGACCUGAAGAUGUACCAG<br>GUGGAGUUCAAGACCAUGAACGCCAAGCUGCUGAUGGACCCCAAGCGGCAGAUCUU<br>CCUGGACCAGAACAUGCUGGCCGUGAUCGACGAGCUGAUGCAGGCCCUGAACUUCA<br>ACAGCGAGACCGUGCCCCAGAAGAGCAGCCUGGAGGAGCCCGACUUCUACAAGACC<br>AAGAUCAAGCUGUGCAUCCUGCUGCACGCCUUCAGAAUCAGAGCCGUGACCAUCGA<br>CAGAGUGAUGAGCUACCUGAACGCCAGCUCUGGUGGCGGAUCAGGCGGCGGCGGUU<br>CAGGAGGCGGUGGAAGUGGAGGUGGCGGGUCUGGCGGAGGUUCACUGCAGGUGGUG<br>GUGAUCAGCGCCAUCCUGGCCCUGGUGGUGCUCACCAUCAUCAGCCUGAUCAUCCU<br>GAUCAUGCUGUGGCAGAAGAAGCCCAGAUACGAGAUCCGGUGGAAGGUGAUCGAGA<br>GCGUGAGCAGCGACGGCCACGAGUUCAUCUUCGUGGACCCCAUGCAGCUGCCCUAC<br>GACAGCACCUGGGAGCUGCCCCGUGAUCAGCUGGUGCUGGGCAGAACCCUGGGCAG<br>CGGCGCCUUCGGCCAGGUGGUGGAGGCUACCGCCCACGGCCUGAGCCACAGCCAGG<br>CCACCAUGAAGGUGGCCGUGGGCAUGCUCAAGAGCACCGCCAGAAGCAGCGAGAAG<br>CAGGCCCUGAUGAGCGAGCUGAAGAUCAUGAGCCAUCUGGGGCCCCACCUGAACGU<br>GGUGAACCUGCUGGGCGCCUGCACCAAGGGCGGCCCCAUCUACAUCAUCACCGAGU<br>ACUGCAGAUACGGCGACCUGGUGGACUACCUGCACAGAAACAAGCACACCUUCCUG<br>CAGCACCACAGCGACAAGAGAAGACCUCCCAGCGCCGAGCUGUACAGCAACGCCCU<br>GCCCGUUGGUCUGCCCCUACCCAGCCACGUGAGCCUGACCGGCGAGAGCGACGGCG<br>GC |
| 282 | h12AB-PTM-ICD-G739tr Nucleotide Sequence | AUGUGCCACCAGCAGCUGGUGAUCAGCUGGUUCAGCCUGGUGUUCCUGGCCAGCCC<br>CCUGGUGGCCAUCUGGGAGCUGAAGAAGGACGUGUACGUGGUGGAGUUGGAUUGGU<br>ACCCCGACGCCCCCGGCGAGAUGGUGGUGCUGACCUGCGACACCCCCGAGGAGGAC<br>GGCAUCACCUGGACCCUGGACCAGAGCAGCGAGGUGCUGGGCAGCGGCAAGACCCU<br>GACCAUCCAGGUGAAGGAGUUCGGCGACGCCGGCCAGUACACCUGCCACAAGGGCG<br>GCGAGGUGCUGAGCCACAGCCUGCUGCUGCUGCACAAGAAGGAGGACGGCAUCUGG<br>AGCACCGACAUCCUGAAGGACCAGAAGGAGCCCAAGAACAAGACCUUCCUGAGAUG<br>CGAGGCCAAGAACUACAGCGGCAGAUUCACCUGCUGGUGGCUGACCACCAUCAGCA<br>CCGACCUGACCUUCAGCGUGAAGAGCAGCAGAGGCAGCAGCGACCCCCAGGGCGUG<br>ACCUGCGGCGCCGCCACCCUGAGCGCCGAGAGAGUGAGAGGCGACAACAAGGAGUA<br>CGAGUACAGCGUGGAGUGCCAGGAAGAUAGCGCCUGCCCCGCCGCCGAGGAGAGCC<br>UGCCCAUCGAGGUGAUGGUGGACGCCGUGCACAAGCUGAAGUACGAGAACUACACC<br>AGCAGCUUCUUCAUCAGAGAUAUCAUCAAGCCCGACCCCCCCAAGAACCUGCAGCU<br>GAAGCCCCUGAAGAACAGCCGGCAGGUGGAGGUGAGCUGGGAGUACCCCGACACCU<br>GGAGCACCCCCACAGCUACUUCAGCCUGACCUUCUGCGUGCAGGUGCAGGGCAAG<br>AGCAAGAGAGAAGAAAGAuAGAGuGuuCACCGACAAGACCAGCGCCACCGUGAU<br>CUGCAGAAAGAACGCCAGCAUCAGCGUGAGAGCCCAAGAUAGAUACUACAGCAGCA<br>GCUGGAGCGAGUGGGCCAGCGUGCCCUGCAGCGGCGGCGGCGGCGGCAGCAGA<br>AACCUGCCCGUGGCCACCCCCGACCCCGGCAUGUUCCCCUGCCUGCACCACAGCCA<br>GAACCUGCUGAGAGCCGUGAGCAACAUGCUGCAGAAGGCCCGGCAGACCCUGGAGU<br>UCUACCCCUGCACCAGCGAGGAGAUCGACCACGAAGAUAUCACCAAAGAUAAGACC<br>AGCACCGUGGAGGCCUGCCUGCCCCUGGAGCUGACCAAGAACGAGAGCUGCCUGAA<br>CAGCAGAGAGACCAGCUUCAUCACCAACGGCAGCUGCCUGGCCAGCAGAAAGACCA<br>GCUUCAUGAUGGCCCUGUGCCUGAGCAGCAUCUACGAGGACCUGAAGAUGUACCAG<br>GUGGAGUUCAAGACCAUGAACGCCAAGCUGCUGAUGGACCCCAAGCGGCAGAUCUU<br>CCUGGACCAGAACAUGCUGGCCGUGAUCGACGAGCUGAUGCAGGCCCUGAACUUCA<br>ACAGCGAGACCGUGCCCCAGAAGAGCAGCCUGGAGGAGCCCGACUUCUACAAGACC<br>AAGAUCAAGCUGUGCAUCCUGCUGCACGCCUUCAGAAUCAGAGCCGUGACCAUCGA<br>CAGAGUGAUGAGCUACCUGAACGCCAGCUCUGGUGGCGGAUCAGGCGGCGGCGGUU<br>CAGGAGGCGGUGGAAGUGGAGGUGGCGGGUCUGGCGGAGGUUCACUGCAGGUGGUG |

SUMMARY OF SEQUENCES

| SEQ ID NO | Description | Sequence |
|---|---|---|
| | | GUGAUCAGCGCCAUCCUGGCCCUGGUGGUGCUCACCAUCAUCAGCCUGAUCAUCCU GAUCAUGCUGUGGCAGAAGAAGCCCAGAUACGAGAUCCGGUGGAAGGUGAUCGAGA GCGUGAGCAGCGACGGCCACGAGUUCAUCUUCGUGGACCCCAUGCAGCUGCCCUAC GACAGCACCUGGGAGCUGCCCCGUGAUCAGCUGGUGCUGGGCAGAACCCUGGGCAG CGGCGCCUUCGGCCAGGUGGUGGAGGCUACCGCCCACGGCCUGAGCCACAGCCAGG CCACCAUGAAGGUGGCCGUGGCCAUGCUCAAGAGCACCGCCAGAAGCAGCGAGAAG CAGGCCCUGAUGAGCGAGCUGAAGAUCAUGAGCCAUCUGGGGCCCCACCUGAACGU GGUGAACCUGCUGGGCGCCUGCACCAAGGGCGGCCCCAUCUACAUCAUCACCGAGU ACUGCAGAUACGGCGACCUGGUGGACUACCUGCACAGAAACAAGCACACCUUCCUG CAGCACCACAGCGACAAGAGAAGACCUCCCAGCGCCGAGCUGUACAGCAACGCCCU GCCCGUUGGUCUGCCCCUACCCAGCCACGUGAGCCUGACCGGCGAGAGCGACGGCG GC |
| 283 | 3'UTR with mir-122-5p binding site | UGAUAAUAGGCUGGAGCCUCGGUGGCCUAGCUUCUUGCCCCUUGGGCCUCCCCCCA GCCCCUCCUCCCCUUCCUGCACCCGUACCCCCC<u>CAAACACCAUUGUCACACUCCAGU</u> GGUCUUUGAAUAAAGUCUGAGUGGGCGGC |
| 284 | Wild Type IL12B without signa (IL12B) Nucleic Acids | AUAUGGGAACUGAAGAAAGAUGUUUAUGUCUAGAAUUGGAUUGGUAUCCGGAUGC CCCUGGAGAAAUGGUGGUCCUCACCUGUGACACCCCUGAAGAAGAUGGUAUCACCU GGACCUUGGACCAGAGCAGUGAGGUCUUUAGGCUCUGGCAAAACCUGACCAUCCAA GUCAAAGAGUUUGGAGAUGCUGGCCAGUACACCUGUCACAAAGGAGGCGAGGUUCU AAGCCAUUCGCUCCUGCUGCUUCACAAAAAGGAAGAUGGAAUUUGGUCCACUGAUA UUUUAAAGGACCAGAAAGAACCCAAAAAUAAGACCUUUCUAAGAUGCGAGGCCAAG AAUUAUUCUGGACGUUUCACCUGCUGGUGGCUGACGACAACAGUACAGAUUUGAC AUUCAGUGUCAAAAGCAGCAGAGGCUCUUCUGACCCCCAAGGGGUGACGUGCGGAG CUGCUACACUCUCUGCAGAGAGAUCAGAGGGGACAACAAGGAGUAUGAGUACUCA GUGGAGUGCCAGGAGGACAGUGCCUGCCCAGCUGCUGAGGAGAGUCUGCCCAUUGA GGUCAUGGUGGAUGCCGUUCACAAGCUCAAGUAUGAAAACUACACCAGCAGCUUCU UCAUCAGGGACAUCAUCAAACCUGACCCACCCAAGAACUUGCAGCUGAAGCCAUUA AAGAAUUCUCGGCAGGUGGAGGUCAGCUGGGAGUACCCUGACACCUGGAGUACUCC ACAUUCCUACUUCUCCCUGACAUUCUGCGUUCAGGUCCAGGGCAAGAGCAAGAGAG AAAAGAAAGAUAGAGUCUUCACGGACAAGACCUCAGCCACGGUCAUCUGCCGCAAA AAUGCCAGCAUUAGCGUGCGGGCCCAGGACCGCUACUAUAGCUCAUCUUGGAGCGA AUGGGCAUCUGUGCCCUGCAGU |
| 285 | Wild Type IL12A without signal peptide Nucleic acids | AGAAACCUCCCCGUGGCCACUCCAGACCCAGGAAUGUUCCCAUGCCUUCACCACUC CCAAAACCUGCUGAGGGCCGUCAGCAACAUGCUCCAGAAGGCCAGACAAACUCUAG AAUUUUACCCUUGCACUUCUGAAGAGAUUGAUCAUGAAGAUAUCACAAAAGAUAAA ACCAGCACAGUGGAGGCCUGUUUACCAUUGGAAUUAACCAAGAAUGAGAGUUGCCU AAAUUCCAGAGAGACCUCUUUCAUAACUAAUGGGAGUUGCCUGGCCUCCAGAAAGA CCUCUUUUAUGAUGGCCCUGUGCCUUAGUAGUAUUUAUGAAGACUUGAAGAUGUAC CAGGUGGAGUUCAAGACCAUGAAUGCAAAGCUUCUGAUGGAUCCUAAGAGGCAGAU CUUUCUAGAUCAAAACAUGCUGGCAGUUAUUGAUGAGCUGAUGCAGGCCCUGAAUU UCAACAGUGAGACUGUGCCACAAAAAUCCUCCCUUGAAGAACCGGAUUUUUAUAAA ACUAAAAUCAAGCUCUGCAUACUUCUUCAUGCUUUCAGAAUUCGGGCAGUGACUAU UGAUAGAGUGAUGAGCUAUCUGAAUGCUUCC |
| 286 | 5'UTR | GGGAAAUAAGAGAGAAAAGAAGAGUAAGAAGAAAUAUAAGA |
| 287 | V1-5'UTR | GGGAAAUAAGAGAGAAAAGAAGAGUAAGAAGAAAUAUAAGACCCCGGCGCCGCCAC C |
| 288 | V2-5'UTR | GGGAAAUAAGAGAGAAAAGAAGAGUAAGAAGAAAUAUAAGACCCCGGCGCCACC |
| 289 | Standard 5'UTR | GGGAAAUAAGAGAGAAAAGAAGAGUAAGAAGAAAUAUAAGAGCCACC |
| 290 | hIL12AB_001 ORF | AUGUGUCACCAGCAGCUGGUCAUUAGCUGGUUUAGCCUUGUGUUCCUGGCCUCCCC CCUUGUCGCUAUUUGGGAGCUCAAGAAGGACGUGUACGUGGUGGAGCUGGACUGGU ACCCAGACGCGCCCGGAGAGAUGGUAGUUCUGACCUGUGAUACCCCAGAGGAGGAC GGCAUCACCUGGACUCUGGACCAAAGCAGCGAGGUUUUGGGCUCAGGGAAAACGCU GACCAUCCAGGUGAAGGAAUUCGGCGACGCCGGACAGUACACCUGCCAUAAGGGAG GAGAGGUGCUGAGCCAUUCCCUUCUUCUGCUGCACAAGAAAGAGGACGGCAUCUGG CUCUACCGACAUCCUGAAAGACCAGAAGGAGCCCAAGAACAAACCUUCCUGAGGUG CGAGGCCAAGAACUACUCCGGCAGGUUCACUUGUUGGUGGCUGACCACCAUCAGUA CAGACCUGACUUUUAGUGUAAAAAGCUCCAGAGGCUCGUCCGAUCCCCAAGGGGUG ACCUGCGGCGCAGCCACUCUGAGCGCUGAGCGCGUGCGCGGUGACAAUAAAGAGUA CGAGUACAGCGUUGAGUGUCAAGAAGACAGCGCUUGCCCUGCCGCCGAGGAGAGCC UGCCUAUCGAGGUGAUGGUUGACGCAGUGCACAAGCUUAAGUACGAGAAUUACACC AGCUCAUUCUUCAUUAGAGAUAUAAUCAAGCCUGACCCACCCAAGAACCUGCAGCU GAAGCCACUGAAAAACUCACGGCAGGUCGAAGUGAGCUGGGAGUACCCCGACACCU GGAGCACUCCUCAUUCCUAUUUCUCUCUACAUUCUGCGUCCAGGUGCAGGGCAAG AGCAAGCGGGAAAAGAAGGAUCGAGUCUUCACCGACAAAACAAGCGCGACCGUGAU |

| SEQ ID NO | Description | Sequence |
|---|---|---|
|  |  | UUGCAGGAAGAACGCCAGCAUCUCCGUCAGAGCCCAGGAUAGAUACUAUAGUAGCA GCUGGAGCGAGUGGGCAAGCGUGCCCUGUUCCGGCGGCGGGGGCGGGGCAGCCGA AACUUGCCUGUCGCUACCCCGGACCCUGGAAUGUUUCCGUGUCUGCACCACAGCCA GAACCUGCUGAGAGCCGUGUCGAAUAUGCUCCAGAAGGCCCGGCAGACCCUUGAGU UCUACCCCUGUACCAGCGAAGAGAUCGAUCAUGAGGACAUCACGAAAGACAAGACU UCCACCGUCGAGGCUUGUCUCCCGCUGGAGCUGACCAAGAACGAGAGCUGUCUGAA UAGCCGGGAGACAUCUUUCAUCACGAAUGGUAGCUGUCUGGCCAGCAGGAAAACUU CCUUCAUGAUGGCUCUCUGCCUGAGCUCUAUCUAUGAAGAUCUGAAGAUGUAUCAG GUGGAGUUUAAGACUAUGAACGCCAAACUCCUGAUGGACCCAAAAAGGCAAAUCUU UCUGGACCAGAAUAUGCUGGCCGUGAUAGACGAGCUGAUGCAGGCACUGAACUUCA ACAGCGAGACAGUGCCACAGAAAUCCAGCCUGGAGGAGCCUGACUUUUACAAAACU AAGAUCAAGCUGUGUAUCCUGCUGCACGCCUUUAGAAUCCGUGCCGUGACUAUCGA CAGGGUGAUGUCAUACCUCAACGCUUCA |
| 291 | hIL12AB_002 ORF | AUGUGCCACCAGCAGCUGGUGAUCAGCUGGUUCAGCCUGGUGUUCCUGGCCAGCCC CCUGGUGGCCAUCUGGGAGCUGAAGAAGGACGUGUACGUGGUGGAGCUGGACUGGU ACCCCGACGCCCCCGGCGAGAUGGUGGUGCUGACCUGCGACACCCCCGAGGAGGAC GGCAUCACCUGGACCCUGGACCAGAGCAGCGAGGUGCUGGGCAGCGGCAAGACCCU GACCAUCCAGGUGAAGGAGUUCGGCGACGCCGGCCAGUACACCUGCCACAAGGGCG GCGAGGUGCUGAGCCACAGCCUGCUGCUGCUGCACAAGAAGGAGGACGGCAUCUGG AGCACCGACAUCCUGAAGGACCAGAAGGAGCCCAAGAACAAGACCUUCCUGAGAUG CGAGGCCAAGAACUACAGCGGCAGAUUCACCUGCUGGUGGCUGACCACCAUCAGCA CCGACCUGACCUUCAGCGUGAAGAGCAGCAGAGGCAGCAGCGACCCCCAGGGCGUG ACCUGCGGCGCCGCCACCCUGAGCGCCGAGAGAGUGAGAGGCGACAACAAGGAGUA CGAGUACAGCGUGGAGUGCCAGGAGGACAGCGCCUGCCCCGCCGCCGAGGAGAGCC UGCCCAUCGAGGUGAUGGUGGACGCCGUGCACAAGCUGAAGUACGAGAACUACACC AGCAGCUUCUUCAUCAGAGACAUCAUCAAGCCCGACCCCCCCAAGAACCUGCAGCU GAAGCCCCUGAAGAACAGCAGACAGGUGGAGGUGAGCUGGGAGUACCCCGACACCU GGAGCACCCCCCACAGCUACUUCAGCCUGACCUUCUGCGUGCAGGUGCAGGGCAAG AGCAAGAGAGAGAAGAAGGACAGAGUGUUCACCGACAAGACCAGCGCCACCGUGAU CUGCAGAAAGAACGCCAGCAUCAGCGUGAGAGCCCAGGACAGAUACUACAGCAGCA GCUGGAGCGAGUGGGCCAGCGUGCCCUGCAGCGGCGGCGGCGGCGGCGGCAGCAGA AACCUGCCCGUGGCCACCCCCGACCCCGGCAUGUUCCCCUGCCUGCACCACAGCCA GAACCUGCUGAGAGCCGUGAGCAACAUGCUGCAGAAGGCCAGACAGACCCUGGAGU UCUACCCCUGCACCAGCGAGGAGAUCGACCACGAGGACAUCACCAAGGACAAGACC AGCACCGUGGAGGCCUGCCUGCCCCUGGAGCUGACCAAGAACGAGAGCUGCCUGAA CAGCAGAGAGACCAGCUUCAUCACCAACGGCAGCUGCCUGGCCAGCAGAAAGACCA GCUUCAUGAUGGCCCUGUGCCUGAGCAGCAUCUACGAGGACCUGAAGAUGUACCAG GUGGAGUUCAAGACCAUGAACGCCAAGCUGCUGAUGGACCCCAAGAGACAGAUCUU CCUGGACCAGAACAUGCUGGCCGUGAUCGACGAGCUGAUGCAGGCCCUGAACUUCA ACAGCGAGACCGUGCCCCAGAAGAGCAGCCUGGAGGAGCCCGACUUCUACAAGACC AAGAUCAAGCUGUGCAUCCUGCUGCACGCCUUCAGAAUCAGAGCCGUGACCAUCGA CAGAGUGAUGAGCUACCUGAACGCCAGC |
| 292 | hIL12AB_003 ORF | AUGUGUCACCAGCAGUUGGUCAUCUCUUGGUUUUCCCUGGUUUUUCUGGCAUCUCC CCUCGUGGCCAUAUGGGAACUGAAGAAAGAUGUUUAUGUCGUAGAAUUGGAUUGGU AUCCGGAUGCCCCUGGAGAAAUGGUGGUCCUCACCUGUGACACCCCUGAAGAAGAU GGUAUCACCUGGACCUUGGACCAGAGCAGUGAGGUCUUAGGCUCUGGCAAAACCCU GACCAUCCAAGUCAAAGAGUUUGGAGAUGCUGGCCAGUACACCUGUCACAAGGAG GCGAGGUUCUAAGCCAUUCGCUCCUGCUGCUUCACAAAAAGGAAGAUGGAAUUUGG UCCACUGAUAUUUUAAAGGACCAGAAAGAACCCAAAAAUAAGACCUUUCUAAGAUG CGAGGCCAAGAAUUAUUCUGGACGUUUCACCUGCUGGUGGCUGACGACAAUCAGUA CUGAUUUGACAUUCAGUGUCAAAAGCAGCAGAGGCUCUUCUGACCCCCAAGGGGUG ACGUGCGGAGCUGCUACACUCUCUGCAGAGAGAGUCAGAGGGGACAACAAGGAGUA UGAGUACUCAGUGGAGUGCCAGGAGGACAGUGCCUGCCCAGCUGCUGAGGAGAGUC UGCCCAUUGAGGUCAUGGUGGAUGCCGUUCACAAGCUCAAGUAUGAAAACUACACC AGCAGCUUCUUCAUCAGGGACAUCAUCAAACCUGACCCACCCAAGAACUUGCAGCU GAAGCCAUUAAAGAAUUCUCGGCAGGUGGAGGUCAGCUGGGAGUACCCUGACACCU GGAGUACUCCACAUUCCUACUUCUCCCUGACAUUCUGCGUUCAGGUCCAGGGCAAG AGCAAGAGAGAAAAGAAAGAUAGAGUCUUCACGGACAAGACCUCAGCCACGGUCAU CUGCCGCAAAAAUGCCAGCAUUAGCGUGCGGGCCCAGGACCGCUACUAUAGCUCAU CUUGGAGCGAAUGGGCAUCUGUGCCCUGCAGUGGCGGAGGGGCGGAGGGAGCAGA AACCUCCCCGUGGCCACUCCAGACCCAGGAAUGUUCCCAUGCCUUCACCACUCCCA AAACCUGCUGAGGGCCGUCAGCAACAUGCUCCAGAAGGCCAGACAAACUUUAGAAU UUUACCCUUGCACUUCUGAAGAGAUUGAUCAUGAAGAUAUCACAAAAGAUAAAACC AGCACAGUGGAGGCCUGUUUACCAUUGGAAUUAACCAAGAAUGAGAGUUGCCUAAA UUCCAGAGAGACCUCUUUCAUAACUAAUGGGAGUUGCCUGGCCUCCAGAAAGACCU CUUUUAUGAUGGCCCUGUGCCUUAGUAGUAUUUAUGAAGACUUGAAGAUGUACCAG GUGGAGUUCAAGACCAUGAAUGCAAAGCUUCUGAUGGAUCCUAAGAGGCAGAUCUU UUUAGAUCAAAACAUGCUGGCAGUUAUUGAUGAGCUGAUGCAGGCCCUGAAUUUCA ACAGUGAGACUGUGCCACAAAAAUCCUCCCUUGAAGAACCGGACUUCUACAAGACC AAGAUCAAGCUCUGCAUACUUCUUCAUGCUUUCAGAAUUCGGGCAGUGACUAUUGA UAGAGUGAUGAGCUAUCUGAAUGCUUCC |

SUMMARY OF SEQUENCES

| SEQ ID NO | Description | Sequence |
|---|---|---|
| 293 | hIL12AB_004 ORF | AUGGGCUGCCACCAGCAGCUGGUCAUCAGCUGGUUCUCCCUGGUCUUCCUGGCCAG CCCCCUGGUGGCCAUCUGGGAGCUGAAGAAAGAUGUCUAUGUUGUAGAGCUGGACU GGUACCCAGAUGCUCCUGGAGAAAUGGUGGUUCUCACCUGUGACACGCCAGAAGAA GAUGGCAUCACCUGGACGCUGGACCAGAGCUCAGAAGUUCUUGGCAGUGGAAAAAC GCUGACCAUACAAGUAAAAGAAUUUGGGGAUGCUGGCCAGUACACCUGCCACAAAG GAGGAGAAGUUCUCAGCCACAGCCUGCUGCUGCUGCACAAGAAAGAAGAUGGCAUC UGGAGCACAGACAUUUUAAAAGACCAGAAGGAGCCCAAGAACAAAACCUUCCUUCG AUGUGAGGCCAAGAACUACAGUGGCCGCUUCACCUGCUGGUGGCUCACCACCAUCA GCACAGACCUCACCUUCUCGGUGAAGAGCAGCCGUGGCAGCUCAGACCCCCAAGGA GUCACCUGUGGGGCGGCCACGCUGUCGGCAGAAAGAGUUCGAGGGGACAACAAGGA AUAUGAAUACUCGGUGGAAUGUCAAGAAGACUCGGCCUGCCCGGCGGCAGAAGAAA GUCUUCCCAUAGAAGUCAUGGUGGAUGCUGUUCACAAAUUAAAAUAUGAAAACUAC ACCAGCAGCUUCUUCAUCAGAGACAUCAUCAAGCCAGACCCGCCCAAGAACCUGCA GCUGAAGCCCCUGAAGAACAGCAGACAAGUGGAAGUUUCCUGGGAGUACCCAGACA CGUGGAGCACGCCGCACAGCUACUUCAGCCUCACCUUCUGUGUACAAGUACAAGGC AAGAGCAAGAGAGAGAAGAAAGAUCGUGUCUUCACAGACAAAACCUCGGCGACGGU CAUCUGCAGGAAGAAUGCCUCCAUCUCGGUUCGAGCCCAGGACCGCUACUACAGCA GCAGCUGGAGUGAGUGGGCCUCGGUGCCCUGCAGUGGUGGCGGCGGCGGCAGC AGAAACCUUCCUGUGGCCACGCCGGACCCUGGCAUGUUCCCGUGCCUGCACCACAG CCAAAAUUUACUUCGAGCUGUUUCUAACAUGCUGCAGAAAGCAAGACAAACUUUAG AAUUCUACCCCUGCACCUCAGAAGAAAUAGACCAUGAAGACAUCACCAAAGAUAAA ACCAGCACUGUAGAGGCCUGCCUGCCCCUGGAGCUCACCAAGAAUGAAUCCUGCCU CAACAGCAGAGAGACCAGCUUCAUCACCAAUGGCAGCUGCCUGGCCAGCAGGAAAA CCAGCUUCAUGAUGGCGCUCUGCCUGAGCAGCAUCUAUGAAGAUUUGAAGAUGUAC CAAGUAGAAUUUAAAACCAUGAAUGCCAAGCUGCUCAUGGACCCCAAGAGACAAAU AUUUUUGGAUCAAACAUGCUGGCUGUCAUUGAUGAGCUCAUGCAAGCAUUAAACU UCAACUCAGAGACGGUGCCCCAGAAGAGCAGCCUGGAGGAGCCAGACUUCUACAAA ACCAAGAUCAAGCUCUGCAUCUUAUUACAUGCCUUCCGCAUCCGGGCGGUCACCAU UGACCGUGUCAUGUCCUACUUAAAUGCCAGC |
| 294 | hIL12AB_005 ORF | AUGUGCCACCAGCAGCUGGUCAUCAGCUGGUUCUCCCUGGUCUUCCUGGCCAGCCC CCUGGUGGCCAUCUGGGAGCUGAAGAAAGAUGUCUAUGUUGUAGAGCUGGACUGGU ACCCAGAUGCUCCUGGAGAAAUGGUGGUUCUCACCUGUGACACGCCAGAAGAAGAU GGCAUCACCUGGACGCUGGACCAGAGCUCAGAAGUUCUUGGCAGUGGAAAAACGCU GACCAUACAAGUAAAAGAAUUUGGGGAUGCUGGCCAGUACACCUGCCACAAAGGAG GAGAAGUUCUCAGCCACAGCCUGCUGCUGCUGCACAAGAAAGAAGAUGGCAUCUGG AGCACAGACAUUUUAAAAGACCAGAAGGAGCCCAAGAACAAAACCUUCCUUCGAUG UGAGGCCAAGAACUACAGUGGCCGCUUCACCUGCUGGUGGCUCACCACCAUCAGCA CAGACCUCACCUUCUCGGUGAAGAGCAGCCGUGGCAGCUCAGACCCCCAAGGAGUC ACCUGUGGGGCGGCCACGCUGUCGGCAGAAAGAGUUCGAGGGGACAACAAGGAAUA UGAAUACUCGGUGGAAUGUCAAGAAGACUCGGCCUGCCCGGCGGCAGAAGAAGUC UUCCCAUAGAAGUCAUGGUGGAUGCUGUUCACAAAUUAAAAUAUGAAAACUACACC AGCAGCUUCUUCAUCAGAGACAUCAUCAAGCCAGACCCGCCCAAGAACCUGCAGCU GAAGCCCCUGAAGAACAGCAGACAAGUGGAAGUUUCCUGGGAGUACCCAGACACGU GGAGCACGCCGCACAGCUACUUCAGCCUCACCUUCUGUGUACAAGUACAAGGCAAG AGCAAGAGAGAGAAGAAAGAUCGUGUCUUCACAGACAAAACCUCGGCGACGGUCAU CUGCAGGAAGAAUGCCUCCAUCUCGGUUCGAGCCCAGGACCGCUACUACAGCAGCA GCUGGAGUGAGUGGGCCUCGGUGCCCUGCAGUGGUGGCGGCGGCGGCAGCAGA AACCUUCCUGUGGCCACGCCGGACCCUGGCAUGUUCCCGUGCCUGCACCACAGCCA AAAUUUACUUCGAGCUGUUUCUAACAUGCUGCAGAAAGCAAGACAAACUUUAGAAU UCUACCCCUGCACCUCAGAAGAAAUAGACCAUGAAGACAUCACCAAAGAUAAAACC AGCACUGUAGAGGCCUGCCUGCCCCUGGAGCUCACCAAGAAUGAAUCCUGCCUCAA CAGCAGAGAGACCAGCUUCAUCACCAAUGGCAGCUGCCUGGCCAGCAGGAAAACCA GCUUCAUGAUGGCGCUCUGCCUGAGCAGCAUCUAUGAAGAUUUGAAGAUGUACCAA GUAGAAUUUAAAACCAUGAAUGCCAAGCUGCUCAUGGACCCCAAGAGACAAAUAUU UUUGGAUCAAACAUGCUGGCUGUCAUUGAUGAGCUCAUGCAAGCAUUAAACUUCA ACUCAGAGACGGUGCCCCAGAAGAGCAGCCUGGAGGAGCCAGACUUCUACAAAACC AAGAUCAAGCUCUGCAUCUUAUUACAUGCCUUCCGCAUCCGGGCGGUCACCAUUGA CCGUGUCAUGUCCUACUUAAAUGCCAGC |
| 295 | hIL12AB_006 ORF | AUGUGCCACCAGCAGCUGGUGAUCAGCUGGUUCAGCCUGGUGUUCCUGGCCAGCCC CCUGGUGGCCAUCUGGGAGCUGAAGAAGGACGUGUACGUGGUGGAGCUGGACUGGU ACCCCGACGCCCCGGCGAGAUGGUGGUGCUGACCUGUGACACCCCCGAGGAGGAC GGCAUCACCUGGACCCUGGACCAGAGCAGCGAGGUGCUGGGCAGCGGCAAGACCCU GACCAUCCAGGUGAAGGAGUUCGGGGACGCCGGCCAGUACACCUGCCACAAGGGCG GCGAGGUGCUGAGCCACAGCCUGCUGCUGCUGCACAAGAAGGAGGACGGCAUCUGG AGCACAGAUAUCCUGAAGGACCAGAAGGAGCCCAAGAACAAGACCUUCCUGAGAUG CGAGGCCAAGAACUACAGCGGCAGAUUCACCUGCUGGUGGCUGACCACCAUCAGCA CAGACUUGACCUUCAGCGUGAAGAGCAGCAGAGGCAGCAGCGACCCCCAGGGCGUG ACCUGCGGCGCCGCCACCCUGAGCGCCGAGAGAGUGAGAGGGGACAACAAGGAGUA CGAGUACAGCGUGGAGUGCCAGGAGGACAGCGCCUGCCCCGCCGCCGAGGAGAGCC UGCCCAUCGAGGUGAUGGUGGACGCCGUGCACAAGCUGAAGUACGAGAACUACACC AGCAGCUUCUUCAUCAGAGACAUCAUCAAGCCCGACCCGCCGAAGAACCUGCAGCU

| SEQ ID NO | Description | Sequence |
|---|---|---|
| | | GAAGCCCCUGAAGAACAGCAGACAGGUGGAGGUGAGCUGGGAGUACCCCGACACCU<br>GGAGCACCCCCACAGCUACUUCAGCCUGACCUUCUGCGUGCAGGUGCAGGGCAAG<br>AGCAAGAGAGAGAAGAAGGACAGAGUGUUCACAGAUAAGACCAGCGCCACCGUGAU<br>CUGCAGAAAGAACGCCAGCAUCAGCGUGAGAGCCCAGGACAGAUACUACAGCAGCA<br>GCUGGAGCGAGUGGGCCAGCGUGCCCUGCAGCGGCGGCGGCGGCGGCAGCAGA<br>AACCUGCCCGUGGCCACCCCCGACCCCGGCAUGUUCCCCUGCCUGCACCACAGCCA<br>GAACCUGCUGAGAGCCGUGAGCAACAUGCUGCAGAAGGCCAGACAGACCCUGGAGU<br>UCUACCCCUGCACCAGCGAGGAGAUCGACCACGAGGACAUCACCAAGGACAAGACC<br>AGCACCGUGGAGGCCUGCCUGCCCCUGGAGCUGACCAAGAAUGAAAGCUGCCUGAA<br>CAGCAGAGAGACCAGCUUCAUCACCAACGGCAGCUGCCUGGCCAGCAGAAAGACCA<br>GCUUCAUGAUGGCCCUGUGCCUGAGCAGCAUCUACGAGGACCUGAAGAUGUACCAG<br>GUGGAGUUCAAGACCAUGAACGCCAAGCUGCUGAUGGACCCCAAGAGACAGAUCUU<br>CCUGGACCAGAACAUGCUGGCCGUGAUCGACGAGCUGAUGCAGGCCCUGAACUUCA<br>ACAGCGAGACCGUGCCCCAGAAGAGCAGCCUGGAGGAGCCCGACUUCUACAAGACC<br>AAGAUCAAGCUGUGCAUCCUGCUGCACGCCUUCAGAAUCAGAGCCGUGACCAUCGA<br>CAGAGUGAUGAGCUACCUGAACGCCAGC |
| 296 | hIL12AB_007 ORF | AUGUGCCACCAGCAGCUUGUCAUCUCCUGGUUCUCUCUUGUCUUCCUUGCUUCUCC<br>UCUUGUGGCCAUCUGGGAGCUGAAGAAGGAUGUUUAUGUUGUGGAGUUGGACUGGU<br>ACCCUGAUGCUCCUGGAGAAAUGGUGGUUCUCACCUGUGACACUCCUGAGGAGGAU<br>GGCAUCACCUGGACUUUGGACCAGUCUUCUGAGGUUCUUGGCAGUGGAAAAACUCU<br>UACUAUUCAGGUGAAGGAGUUUGGAGAUGCUGGCCAGUACACCUGCCACAAGGGGUG<br>GUGAAGUUCUCAGCCACAGUUUACUUCUUCUUCACAAGAAGGAGGAUGGCAUCUGG<br>UCUACUGACAUUUAAAAGACCAGAAGGAGCCCAAGAACAAGACUUUCCUUCGUUG<br>UGAAGCCAAGAACUACAGUGGUCGUUUCACCUGCUGGUGGCUUACUACUAUUUCUA<br>CUGACCUUACUUUCUCUGUGAAGUCUUCUCGUGGCUCUUCUGACCCUCAGGGUGUC<br>ACCUGUGGGGCUGCUACUCUUUCUGCUGAGCGUGUGCGUGGGGACAACAAGGAGUA<br>UGAAUACUCGUGGAGUGCCAGGAGGACUCUGCCUGCCCUGCUGCUGAGGAGUCUC<br>UUCCUAUUGAGGUGAUGGUGGAUGCUGUGCACAAGUUAAAAUAUGAAAACUACACU<br>UCUUCUUUCUUCAUUCUGACAUUAUAAAACCUGACCCUCCCAAGAACCUUCAGUU<br>AAAACCUUUAAAAAACUCUCGUCAGGUGGAGGUGUCCUGGGAGUACCCUGACACGU<br>GGUCUACUCCUCACUCCUACUUCUCUCUUACUUUCUGUGUCCAGGUGCAGGGCAAG<br>UCCAAGCGUGAGAAGAAGGACCGUGUCUUCACUGACAAGACUUCUGCUACUGUCAU<br>CUGCAGGAAGAAUGCAUCCAUCUCUGUGCGUGCUCAGGACCGUUACUACAGCUCUU<br>CCUGGUCUGAGUGGGCUUCUGUGCCCUGCUCUGGCGGCGGCGGCGGCAGCAGA<br>AAUCUUCCUGUGGCUACUCCUGACCCUGGCAUGUUCCCCUGCCUUCACCACUCGCA<br>GAACCUUCUUCGUCGUGAGCAACAUGCUUCAGAAGGCUCGUCAGACUUUAGAAU<br>UCUACCCCUGCACUUCUGAGGAGAUUGACCAUGAAGACAUCACCAAGGACAAGACU<br>UCUACUGUGGAGGCCUGCCUUCCUUUAGAGCUGACCAAGAAUGAAUCCUGCUUAAA<br>UUCUCGUGAGACUUCUUUCAUCACCAAUGGCAGCUGCCUUGCCUCGCGCAAGACUU<br>CUUUCAUGAUGGCUCUUUGCCUUUCUUCCAUCUAUGAAGACUUUAAAAAUGUACCAG<br>GUGGAGUUCAAGACCAUGAAUGCAAAGCUUCUCAUGGACCCCAAGCGUCAGAUAUU<br>UUUGGACCAGAACAUGCUUGCUGUCAUUGAUGAGCUCAUGCAGGCUUUAAACUUCA<br>ACUCUGAGACUGUGCCUCAGAAGUCUUCUUUAGAAGAGCCUGACUUCUACAAGACC<br>AAGAUAAAACUUUGCAUUCUUCUUCAUGCUUUCCGCAUCCGUGCUGUGACUAUUGA<br>CCGUGUGAUGUCCUACUUAAAUGCUUCU |
| 297 | hIL12AB_008 ORF | AUGUGUCAUCAACAACUCGUGAUUAGCUGGUUCAGUCUCGUGUUCCUGGCCUCUCC<br>GCUGGUGGCCAUCUGGGAGCUUAAGAAGGACGUGUACGUGGUGGAGCUCGAUUGGU<br>ACCCCGAUGCUCCUGGCGAGAUGGUGGUGCUAACCUGCGAUACCCCCGAGGAGGAC<br>GGGAUCACUUGGACCCUGGAUCAGAGUAGCGAAGUCCUGGGCUCUGGCAAGACACU<br>CACAAUCCAGGUGAAGGAAUUCGGAGACGCUGGUCAGUACACUUGCCACAAGGGGG<br>GUGAAGUGCUGUCUCACAGCCUGCUGUUACUGCACAAGAAGGAGGAUGGGAUCUGG<br>UCAACCGACAUCCUGAAGGAUCAGAAGGAGCCUAAGAACAAGACCUUUCUGAGGUG<br>UGAAGCUAAGAACUAUUCCGGAAGAUUCACUUGCUGGUGGUUGACCACAAUCAGCA<br>CUGACCUGACCUUUUCCGUGAAGUCCAGCAGAGGAAGCAGCGAUCCUCAGGGCGUA<br>ACGUGCGGCGGCUACCCUGUCAGCGUGCGGGUUAGAGGCGACAACAAGAGUA<br>UGAGUACUCCGUGGAGUGUCAGGAGGACAGCGCCUGCCCCGCAGCCGAGGAGAGUC<br>UGCCCAUCGAGGUGAUGGUGGACGCUGUCCAUAAGUUAAAAUACGAAAAUUACACA<br>AGUUCCUUUUUCAUCCGCGAUAUUAUCAAACCCGAUCCCCCAAGAACCUGCAGCU<br>GAAGCCCCUGAAGAAUAGCCGACAGGUGGAAGUCUCUUGGGAGUAUCCUGACACCU<br>GGUCCACGCCUCACAGCUACUUUAGUCUGACUUUCUGUGUCCAGGUCCAGGGCAAG<br>AGCAAGAGAGAGAAAAGGAUAGAGUGUUUACUGACAAGACAUCUGCUACAGUCAU<br>CUGCAGAAAGAACGCCAGUAUCAGUGAGGGCGCAGGACAGAUACUACAGUAGUA<br>GCUGGAGCGAAUGGGCUAGCGUGCCCUGUUCAGGGGCGCGGAGGGGCUCCAGG<br>AAUCUGCCCGUGGCCACCCCCGACCCUGGGAUGUUCCCUUGCCUCCAUCACUCACA<br>GAACCUGCUCAGAGCAGUGAGCAACAUGCUCCAAAAGGCCCGCCAGACCCUGGAGU<br>UUUACCCUUGUACUUCAGAAGAGAUCGAUCACGAAGACAUAACAAAGGAUAAAACC<br>AGCACCGUGGAGGCCUGCUGCCUCUAGAACUCACAAAGAAUGAAAGCUGUCUGAA<br>UUCCAGGGAAACCUCCUUCAUUACUAACGGAAGCUGUCUCGCAUCUCGCAAACAUU<br>CAUUCAUGAUGGCCCUCUGCCUGUCUUCUAUCUAUGAAGAUCUCAAGAUGUAUCAG<br>GUGGAGUUCAAAACAAUGAACGCCAAGCUGCUGAUGGACCCCAAGAGACAGAUCUU<br>CCUGGACCAGAACAUGCUGGCAGUGAUCGAUGAGCUGAUGCAAGCCUUGAACUUCA |

SUMMARY OF SEQUENCES

| SEQ ID NO | Description | Sequence |
|---|---|---|
| | | ACUCAGAGACAGUGCCGCAAAAGUCCUCGUUGGAGGAACCAGAUUUUUACAAAACC<br>AAAAUCAAGCUGUGUAUCCUUCUUCACGCCUUUCGGAUCAGAGCCGUGACUAUCGA<br>CCGGGUGAUGUCAUACCUGAAUGCUUCC |
| 298 | hIL12AB_009 ORF | AUGUGCCACCAGCAGCUGGUCAUCAGCUGGUUUAGCCUGGUCUUCCUGGCCAGCCC<br>CCUGGUGGCCAUCUGGGAGCUGAAGAAAGAUGUCUAUGUUGUAGAGCUGGACUGGU<br>ACCCAGAUGCUCCUGGAGAAAUGGUGGUUCUCACCUGCGACACGCCAGAAGAAGAU<br>GGCAUCACCUGGACGCUGGACCAGAGCAGCGAAGUACUGGGCAGUGGAAAAACGCU<br>GACCAUACAAGUAAAAGAAUUUGGCGAUGCUGGCCAGUACACCUGCCACAAAGGAG<br>GAGAAGUACUGAGCCACAGCCUGCUGCUGCUGCACAAGAAAGAAGAUGGCAUCUGG<br>AGCACCGACAUUUUAAAAGACCAGAAGGAGCCCAAGAACAAAACCUUCCUUCGAUG<br>UGAGGCGAAGAACUACAGUGGCCGCUUCACCUGCUGGUGGCUCACCACCAUCAGCA<br>CCGACCUCACCUUCUCGGUGAAGAGCAGCCGUGGUAGCUCAGACCCCCAAGGAGUC<br>ACCUGUGGGCGGCCACGCUGUCGGCAGAAAGAGUUCGAGGCGACAACAAGGAAUA<br>UGAAUACUCGGUGGAAUGUCAAGAAGACUCGGCCUGCCCGGCGGCAGAAGAAAGUC<br>UGCCCAUAGAAGUCAUGGUGGAUGCUGUUCACAAAUUAAAAUAUGAAAACUACACC<br>AGCAGCUUCUUCAUCAGAGACAUCAUCAAGCCAGACCCCCCAAGAACCUGCAGCU<br>GAAGCCCCUGAAGAACAGCAGACAAGUGGAAGUUUCCUGGGAGUACCCAGACACGU<br>GGAGCACGCCGCACAGCUACUUCAGCCUCACCUUCUGUGUACAAGUACAAGGCAAG<br>AGCAAGAGAGAGAAAAGAUCGUGUCUUCACCGACAAAACCUCGGCGACGGUCAU<br>CUGCAGGAAGAAUGCAAGCAUCUCGGUUCGAGCCCAGGACCGCUACUACAGCAGCA<br>GCUGGAGUGAGUGGGCCUCGGUGCCCUGCAGUGGUGGCGGCGGCGGCGGCAGCAGA<br>AACCUUCCUGUGGCCACGCCGGACCCUGGCAUGUUUCCUGUCCUGCACCACAGCCA<br>AAAUUUAUUACGAGCUGUUAGCAACAUGCUGCAGAAAGCAAGACAAACUUUAGAAU<br>UCUACCCCUGCACCUCAGAAGAAAUAGACCAUGAAGACAUCACCAAAGAUAAAACC<br>AGCACUGUAGAGGCCUGCCUGCCCCUGGAGCUCACCAAGAACGAGAGCUGCCUCAA<br>UAGCAGAGAGACCAGCUUCAUCACCAAUGGCAGCUGCCUGGCCAGCAGGAAAACCA<br>GCUUCAUGAUGGCGCUCUGCCUGAGCAGCAUCUAUGAAGAUCUGAAGAUGUACCAA<br>GUAGAAUUUAAAACCAUGAAUGCCAAGCUGCUCAUGGACCCCAAGAGACAAAUAUU<br>CCUCGACCAAAACAUGCUGGCUGUCAUUGAUGAGCUCAUGCAAGCAUUUAACUUCA<br>ACUCAGAGACGGUGCCCCAGAAGAGCAGCCUGGAGGAGCCAGACUUCUACAAAACC<br>AAGAUCAAGCUCUGCAUCUUAUUACAUGCCUUCCGCAUCCGGGCGGUCACCAUUGA<br>CCGUGUCAUGUCCUACUUAAAUGCCAGC |
| 299 | hIL12AB_010 ORF | AUGUGCCACCAGCAGCUUGUCAUCUCCUGGUUUUCUCUUGUCUUCCUCGCUUCUCC<br>UCUUGUGGCCAUCUGGGAGCUGAAGAAAGAUGUCUAUGUUGUAGAGCUGGACUGGU<br>ACCCGGACGCUCCUGGAGAAAUGGUGGUUCUCACCUGCGACACUCCUGAAGAAGAU<br>GGCAUCACCUGGACGCUGGACCAAAGCAGCGAAGUUUUAGGCUCUGGAAAAACGCU<br>GACCAUACAAGUAAAAGAAUUUGGCGACGCUGGCCAGUACACGUGCCACAAAGGAG<br>GAGAAGUUUUAAGCCACAGUUUACUUCUCUUCACAAGAAAGAAGAUGGCAUCUGG<br>AGUACGGACAUUUUAAAAGACCAGAAGGAGCCUAAGAACAAAACCUUCCUCCGCUG<br>UGAAGCUAAGAACUACAGUGGUCGUUUCACCUGCUGGUGGCUCACCACCAUCUCCA<br>CUGACCUCACCUUCUCUGUAAAAUCAAGCCUGGUUCUUCUGACCCCCAAGGAGUC<br>ACCUGUGGGCUGCCACGCUCAGCGCUGAAAGAGUUCGAGGCGACAACAAGGAAUA<br>UGAAUAUUCUGUGGAAUGUCAAGAAGAUUCUGCCUGCCCGGCGGCAGAAGAAAGUC<br>UUCCCAUAGAAGUCAUGGUGGACGCUGUUCACAAAUUAAAAUAUGAAAACUACACC<br>AGCAGCUUCUUCAUCUGACAUCAUCAAACCAGACCCUCCUAAGAACCUUCAGUU<br>AAAACCGCUGAAGAACAGCAGACAAGUGGAAGUUUCCUGGGAGUACCCGGACACGU<br>GGAGUACGCCGCACACUCCUACUUCAGUUUAACCUUCUGUGUACAAGUACAAGGAAAA<br>UCAAAAAGAGAGAAGAAAGAUCGUGUCUUCACUGACAAAACAUCUGCCACGGUCAU<br>CUGCCGUAAGAACGCUUCCAUCUCGGUUCGAGCCCAGGACCGCUACUACAGCAGCA<br>GCUGGAGUGAGUGGGCAUCUGUUCCCUGCAGUGGUGGCGGCGGCGGCAGCCGC<br>AACCUUCCUGUGGCCACGCCGGACCCUGGCAUGUUCCCUGUCCUUCACCACUCGCA<br>AAAUCUUCUUCGUGCUGUUUCUAACAUGCUGCAGAAGGCGAGACAAACUUUAGAAU<br>UCUACCCGUGCACUUCUGAAGAAAUAGACCAUGAAGACAUCACCAAGGACAAAACC<br>AGCACGGUGGAGGCCUGCCUUCCUUUAGAACUUACUAAGAACGAAAGUUGCCUUAA<br>CAGCCGUGAGACCAGCUUCAUCACCAAUGGCAGCUGCCUUGCUAGCAGGAAGACCA<br>GCUUCAUGAUGGCGCUGUGCCUUUCUUCCAUCUAUGAAGAUCUUAAGAUGUACCAA<br>GUAGAAUUUAAAACCAUGAAUGCCAAAUUAUUAAUGGACCCCAAGAGACAAAUAUU<br>CCUCGACCAAAACAUGCUGGCUGUCAUUGAUGAGCUCAUGCAAGCAUUUAACUUCA<br>ACUCAGAAACUGUUCCCCAGAAGUCAUCUUUAGAAGAACCGGACUUCUACAAAACA<br>AAAAUAAAACUCUGCAUUCUUCUUCAUGCCUUCCGCAUCCGUGCUGUCACCAUUGA<br>CCGUGUCAUGUCCUACUUAAAUGCUUCU |
| 300 | hIL12AB_011 ORF | AUGUGCCACCAGCAGCUGGUGAUCAGCUGGUUCAGCCUGGUGUUCCUGGCCAGCCC<br>CCUGGUGGCCAUCUGGGAGCUGAAGAAGGACGUGUACGUGGUGGAGCUGGACUGGU<br>ACCCGGACGCGCCGGGGGAGAUGGUGGUGCUGACGUGCGACACGCCGGAGGAGGAC<br>GGGAUCACGUGGACGCUGGACCAGAGCAGCGAGGUGCUGGGGAGCGGGAAGACGCU<br>GACGAUCCAGGUGAAGGAGUUCGGGGACGCGGGGCAGUACACGUGCCACAAGGGGG<br>GGGAGGUGCUGAGCCACAGCCUGCUGCUGCUGCACAAGAAGGAGGACGGGAUCUGG<br>AGCACGGACAUCCUGAAGGACCAGAAGGAGCCGAAGAACAAGACGUUCCUGAGGUG<br>CGAGGCGAAGAACUACAGCGGGAGGUUCACGUGCUGGUGGCUGACGACGAUCAGCA<br>CGGACCUGACGUUCAGCGUGAAGAGCAGCAGGGGGAGCAGCGACCCCGCAGGGGGUG |

| SUMMARY OF SEQUENCES | | |
|---|---|---|
| SEQ ID NO | Description | Sequence |
| | | ACGUGCGGGGCGGCGACGCUGAGCGCGGAGAGGGUGAGGGGGACAACAAGGAGUA
CGAGUACAGCGUGGAGUGCCAGGAGGACAGCGCGUGCCCGGCGGCGGAGGAGAGCC
UGCCGAUCGAGGUGAUGGUGGACGCGGUGCACAAGCUGAAGUACGAGAACUACACG
AGCAGCUUCUUCAUCAGGGACAUCAUCAAGCCGGACCCGCCGAAGAACCUGCAGCU
GAAGCCGCUGAAGAACAGCAGGCAGGUGGAGGUGAGCUGGGAGUACCCGGACACGU
GGAGCACGCCGCACAGCUACUUCAGCCUGACGUUCUGCGUGCAGGUGCAGGGGAAG
AGCAAGAGGGAGAAGAAGGACAGGGUGUUCACGGACAAGACGAGCGCGACGGUGAU
CUGCAGGAAGAACGCGAGCAUCAGCGUGAGGGCGCAGGACAGGUACUACAGCAGCA
GCUGGAGCGAGUGGGCGAGCGUGCCGUGCAGCGGGGGGGGGGGGGGGGGAGCAGG
AACCUGCCGGUGGCGACGCCGGACCCGGGGAUGUUCCCGUGCCUGCACCACAGCCA
GAACCUGCUGAGGGCGGUGAGCAACAUGCUGCAGAAGGCGAGGCAGACGCUGGAGU
UCUACCCGUGCACGAGCGAGGAGAUCGACCACGAGGACAUCACGAAGGACAAGACG
AGCACGGUGGAGGCGUGCCUGCCGCUGGAGCUGACGAAGAACGAGAGCUGCCUGAA
CAGCAGGGAGACGAGCUUCAUCACGAACGGGAGCUGCCUGGCGAGCAGGAAGACGA
GCUUCAUGAUGGCGCUGUGCCUGAGCAGCAUCUACGAGGACCUGAAGAUGUACCAG
GUGGAGUUCAAGACGAUGAACGCGAAGCUGCUGAUGGACCCGAAGAGGCAGAUCUU
CCUGGACCAGAACAUGCUGGCGGUGAUCGACGAGCUGAUGCAGGCGCUGAACUUCA
ACAGCGAGACGGUGCCGCAGAAGAGCAGCCUGGAGGAGCCGGACUUCUACAAGACG
AAGAUCAAGCUGUGCAUCCUGCUGCACGCGUUCAGGAUCAGGGCGGUGACGAUCGA
CAGGGUGAUGAGCUACCUGAACGCGAGC |
| 301 | hIL12AB_012 ORF | AUGUGCCAUCAGCAGCUGGUGAUCAGCUGGUUCAGCCUCGUGUUUCUGGCCAGCCC
CCUGGUGGCCAUUUGGGAACUCAAGAAGGACGUGUAUGUAGUGGAACUCGACUGGU
ACCCUGACGCCCCAGGCGAAAUGGUGGUCUUAACCUGCGACACCCCUGAGGAGGAC
GGAAUCACCUGGACCUUGGACCAGAGCUCCGAGGUCCUCGGCAGUGGCAAGACCCU
GACCAUACAGGUGAAAGAAUUUGGAGACGCAGGGCAAUACACAUGUCACAAGGGCG
GGGAGGUUCUUUCUCACUCCCUUCUGCUUCUACAUAAAAAGGAAGACGGAAUUUGG
UCUACCGACAUCCUCAAGGACCAAAAGGAGCUAAAGAAUAAAACCUUCUUACGCUG
UGAAGCUAAAAACUACAGCGGCAGAUUCACUUGCUGGUGGCUCACCACCAUUUCUA
CCGACCUGACCUUCUCGGUGAAGUCUUCAAGGGGCUCUAGUGAUCCACAGGGAGUG
ACAUGCGGGGCCGCCACACUGAGCGCUGAACGGGUGAGGGGCGAUAACAAGGAGUA
UGAAUACUCUGUCGAGUGUCAGGAGGAUUCAGCUUGUCCCGCAGCUGAAGAGCAC
UCCCCAUAGAGGUUAUGGUCGAUGCUGUGCAUAAACUGAAGUACGAAAACUACACC
AGCAGCUUCUUCAUUCGGGACAUUAUAAAACCUGACCCCCCCAAGAACCUGCAACU
UAAACCCCUGAAAAACUCUCGGCAGGUCGAAGUUAGCUGGGAGUACCCUGAUACUU
GGUCCACCCCCACUCGUACUUCUCACUGACUUUCUGUGUGCAGGUGCAGGGCAAG
AGCAAGAGAGAAAAAAGAUCGUGUAUUCACAGACAAGACCUCUGCCACCGUGAU
CUGCAGAAAAAACGCUUCCAUCAGUGUCAGAGCCCAAGACCGGUACUAUAGUAGUA
GCUGGAGCGAGUGGGCAAGUGUCCCCUGCUCUGGCGGCGGAGGGGCGGCUCUCGA
AACCUCCCCGUCGCUACCCCUGAUCCAGGAAUGUUCCCUUGCCUGCAUCACUCACA
GAAUCUGCUGAGAGCGGUCAGCAACAUGCUGCAGAAAGCUAGGCAAACACUGGAGU
UUUAUCCUUGCUACUCAGAGGAGAUCGACCACGAGGAUAUUACCAAGGACAAGACC
AGCACGGUGGAGGCCUGCUUGCCCCUGGAACUGACAAAGAAUGAAUCCUGCCUUAA
UAGCCGUGAGACCUCUUUUAUAACAAACGGAUCCUGCCUGGCCAGCAGGAAGACCU
CCUUCAUGAUGGCCCUCUGCCUGUCCUCAAUCUACGAAGACCUGAAGAUGUACCAG
GUGGAAUUUAAAACUAUGAACGCCAAGCUGUUUAUGGACCCCAAGCGGCAGAUCUU
UCUGGAUCAAAAUAUGCUGGCUGUGAUCGACGAACUGAUGCAGGCCCUCAACUUUA
ACAGCGAGACCGUGCCACAAAAGAGCAGUCUUGAGGAGCCCGACUUCUACAAGACC
AAGAUCAAGCUGUGCAUCCUCCUUCAUGCCUUCAGGAUAAGAGCUGUCACCAUCGA
CAGAGUCAUGAGUUACCUGAAUGCAUCC |
| 302 | hIL12AB_013 ORF | AUGUGCCACCAGCAGCUGGUCAUCUCCUGGUUCAGCUUGUCUUCCUGGCCUCGCC
GCUGGUGGCCAUCUGGGAGCUGAAGAAGGAUGUUUAUGUUGUAGAGCUGGACUGGU
ACCCAGAUGCUCCUGGAGAAAUGGUGGUCCUCACCUGUGACACGCCAGAAGAAGAU
GGCAUCACCUGGACGCUGGACCAGAGCAGUGAAGUUCUGGGAAGUGGAAAAACGCU
GACCAUACAAGUAAAAGAAUUUGGAGAUGCUGGCCAGUACACCUGCCACAAAGGAG
GAGAAGUUCUCAGCCACAGUUAUUAUUACUUCACAAGAAGAAGAUGGCAUCUGG
UCCACGGACAUUUUAAAAGACCAGAAGGAGCCCAAAAAUAAAACAUUUCUUCGAUG
UGAGGCCAAGAACUACAGUGGUCGUUUCACCUGCUGGUGGCUGACCACCAUCUCCA
CAGACCUCACCUUCAGUGUAAAAAGCAGCCGUGGUUCUUCUGACCCCCCAAGGAGUC
ACCUGUGGGCUGCCACGCUCUCUGCAGAAAGAGUUCGAGGGGACAACAAAGAAUA
UGAGUACUCGGUGGAAUGUCAAGAAGACUCGGCCUGCCCAGCUGCUGAGGAGAGUC
UUCCCAUAGAAGUCAUGGUGGAUGCUGUUCACAAAUUAAAAUAUGAAAACUACACC
AGCAGCUUCUUCAUCAGAGACAUCAUCAAAACCUGACCCGCCCAAGAACUUACAGCU
GAAGCCGCUGAAAAACAGCAGACAAGUAGAAGUUUCCUGGGAGUACCCGGACACCU
GGUCCACGCCGCACUCCUACUUCUCCCUCACCUUCUGUGUACAAGUACAAGGCAAG
AGCAAGAGAGAGAAAAAGAUCGUGUCACGGACAAAACAUCAGCCACGGUCAU
CUGCAGGAAAAAUGCCAGCAUCUCGGUGCGGGCCCAGGACCGCUACUACAGCAGCA
GCUGGAGUGAGUGGGCAUCUGUGCCCUGCAGUGGUGGUGGGGGUGGUGGCAGCAGA
AACCUUCCUGUGGCCACUCCAGACCCUGGCAUGUUCCCGUGCCUUCACCACUCCCA
AAAUUUACUUCGAGCUGUUUCUAACAUGCUGCAGAAAGCAAGACAAACUUUAGAAU
UCUACCCCGUGCACUUCUGAAGAAAUUGACCAUGAAGACAUCACAAAAGAUAAAACC
AGCACAGUGGAGGCCUGUCUUCCCUUUAGAGCUGACCAAAAAUGAAUCCUGCCUCAA |

| SUMMARY OF SEQUENCES | | |
|---|---|---|
| SEQ ID NO | Description | Sequence |
| | | CAGCAGAGAGACCAGCUUCAUCACCAAUGGCAGCUGCCUGGCCUCCAGGAAAACCA GCUUCAUGAUGGCGCUCUGCCUCAGCUCCAUCUAUGAAGAUUUGAAGAUGUACCAA GUAGAAUUUAAAACCAUGAAUGCCAAAUUAUUAAUGGACCCCAAGAGGCAGAUAUU UUUAGAUCAAAACAUGCUGGCAGUUAUUGAUGAGCUCAUGCAAGCAUUAAACUUCA ACAGUGAGACUGUACCUCAAAAAAGCAGCCUUGAAGAGCCGGACUUCUACAAAACC AAGAUCAAACUCUGCAUUUUACUUCAUGCCUUCCGCAUCCGGGCGGUCACCAUUGA CCGUGUCAUGUCCUACUUAAAUGCCUCG |
| 303 | hIL12AB_014 ORF | AUGUGCCACCAGCAGCUUGUGAUUUCUUGGUUCUCUCUUGUGUUCCUUGCUUCUCC UCUUGUGGCUAUUUGGGAGUUAAAAAGGACGUGUACGUGGUGGAGCUUGACUGGU ACCCUGAUGCUCCUGGCGAGAUGGUGGUGCUUACUUGUGACACUCCUGAGGAGGAC GGCAUUACUUGGACUCUUGACCAGUCUUCUGAGGUGCUUGGCUCUGGCAAGACUCU UACUAUUCAGGUGAAGGAGUUCGGGGAUGCUGGCCAGUACACUUGCCACAAGGGCG GCGAGGUGCUUUCUCACUCUCUUCUUCUUCACAAGAAGGAGGACGGCAUUUGG UCUACUGACAUUUUAAAAGACCAGAAGGAGCCCAAGAACAAGACUUUCCUUCGUUG CGAGGCCAAGAACUACUCUGGCCGUUUCACUUGCUGGUGGCUUACUACUAUUUCUA CUGACCUUACUUUCUCUGUGAAGUCUUCUCGUGGCUCUUCUGACCCUCAGGGCGUG ACUUGUGGGGCUGCUACUCUUUCUGCUGAGCGUGUGCGUGGGGACAACAAGGAGUA CGAGUACUCUGUGGAGUGCCAGGAGGACUCUGCUUGCCCUGCUGCUGAGGAGUCUC UUCCUAUUGAGGUGAUGGUGGAUGCUGUGCACAAGUUAAAAUACGAGAACUACACU UCUUCUUUCUUCAUUCUGUGACAUUAUUAAGCCUGACCCUCCCAAGAACCUUCAGUU AAAACCUUUAAAAAACUCUCGUCAGGUGGAGGUGUCUUGGGAGUACCCUGACACUU GGUCUACUCCUCACUCUUACUUCUCUCUUACUUUCUGCGUGCAGGUGCAGGGCAAG UCUAAGCGUGAGAAGAAGGACCGUGUGUUCACUGACAAGACUUCUGCUACUGUGAU UUGCAGGAAGAAUGCAUCUAUUUCUGUGCGUGCUCAGGACCGUUACUACUCUUCUU CUUGGUCUGAGUGGGCUUCUGUGCUUGCUCUGGCGGCGGCGGCGGCGGCUCUAGA AAUCUUCCUGUGGCUACUCCUGACCCUGGCAUGUUCCCUUGCCUUCACCACUCUCA GAACCUUCUUCGUGCUGUGAGCAACAUGCUUCAGAAGGCUCGUCAGACUCUUGAGU CUACCCUUGCACUUCUGAGGAGAUUGACCACGAGGACAUCACCAAGGACAAGACU UCUACUGUGGAGGCUUGCCUUCCUCUUGAGCUUACCAAGAAUGAAUCUUGCUUAAA UUCUCGUGAGACUUCUUUCAUCACCAACGGCUCUUGCCUUGCCUCGCGCAAGACUU CUUUCAUGAUGGCUCUUUGCCUUUCUUCUAUUUACGAGGACUUUAAAAAUGUACCAG GUGGAGUUCAAGACUAUGAAUGCAAAGCUUCUUAUGGACCCCAAGCGUCAGAUUUU CCUUGACCAGAACAUGCUUGCUGUGAUUGACGAGCUUAUGCAGGCUUUAAAUUUCA ACUCUGAGACUGUGCCUCAGAAGUCUUCUCUUGAGGAGCCUGACUUCUACAAGACC AAGAUUAAGCUUUGCAUUCUUCUUCAUGCUUUCCGUAUUCGUGCUGUGACUAUUGA CCGUGUGAUGUCUUACUUAAAUGCUUCU |
| 304 | hIL12AB_015 ORF | AUGUGUCACCAGCAGCUGGUGAUCAGCUGGUUUAGCCUGGUGUUUCUGGCCAGCCC CCUGGUGGCCAUAUGGGAACUGAAGAAAGAUGUGUAUGUGGUAGAACUGGAUUGGU AUCCGGAUGCCCCCGGCGAAAUGGUGGUGCUGACCUGUGACACCCCCGAAGAAGAU GGUAUCACCUGGACCCUGGACCAGAGCAGCGAGGUGCUGGGCAGCGGCAAAACCCU GACCAUCCAAGUGAAAGAGUUUGGCGAUGCCGGCCAGUACACCUGUCACAAAGGCG GCGAGGUGCUAAGCCAUUCGCUGCUGCUGCUGCACAAAAAGGAAGAUGGCAUCUGG AGCACCGAUAUCCUGAAGGACCAGAAAGAACCCAAAAAUAAGACCUUUCUAAGGAUG CGAGGCCAAGAAUUAUAGCGGCCGUUUCACCUGCUGGUGGCUGACGACCAUCAGCA CCGAUCUGACCUUCAGCGUGAAAAGCAGCAGAGGCAGCAGCGACCCCCAAGGCGUG ACGUGCGGCGCCGCCACCCUGAGCGCCGAGAGAGUGAGAGGCGACAACAAGGAGUA UGAGUACAGCGUGGAGUGCCAGGAGGACAGCGCCUGCCCCGCCGCCGAGGAGAGCC UGCCCAUCGAGGUGAUGGUGGAUGCCGUGCACAAGCUGAAGUAUGAAAACUACACC AGCAGCUUCUUCAUCAGAGACAUCAUCAAACCCGACCCCCCCAAGAACCUGCAGCU GAAGCCCCUGAAGAAUAGCAGACAGGUGGAGGUGAGCUGGGAGUACCCCGACACCU GGAGCACCCCCCAUAGCUACUUCAGCCUGACCUUCUGCGUGCAGGUGCAGGGCAAG AGCAAGAGAGAAAAGAAAGAUAGAGUGUUCACGGACAAGACCAGCGCCACGGUGAU CUGCAGAAAAAAUGCCAGCAUCAGCGUGAGAGCCCAGGACAGAUACUAUAGCAGCA GCUGGAGCGAAUGGGCCAGCGUGCCCUGCAGCGGCGGCGGCGGCGGCAGCAGA AACCUGCCCGUGGCCACCCCCGACCCCGGCAUGUUCCCCUGCCUGCACCACAGCCA AAACCUGCUGAGAGCCGUGAGCAACAUGCUGCAGAAGGCCAGACAAAACCCUGGAAU UUUACCCCUGCACCAGCGAAGAGAUCGAUCAUGAAGAUAUCACCAAAGAUAAAACC AGCACCGUGGAGGCCUGUCUGCCCCUGGAACUGACCAAGAAUGAGAGCUGCCUAAA UAGCAGAGAGACCAGCUUCAUAACCAAUGGCAGCUGCCUGGCCAGCAGAAAGACCA GCUUUAUGAUGGCCCUGUGCCUGAGCAGCAUCUAUGAAGACCUGAAGAUGUACCAG GUGGAGUUCAAGACCAUGAAUGCCAAGCUGCUGAUGGAUCCCAAGAGACAGAUCUU UCUGGAUCAAAACAUGCUGGCCGUGAUCGAUGAGCUGAUGCAGGCCCUGAAUUUCA ACAGCGAGACCGUGCCCCAAAAAGCAGCCUGGAAGAACCGGAUUUUUAUAAAACC AAAAUCAAGCUGUGCAUACUGCUGCAUGCCUUCAGAAUCAGAGCCGUGACCAUCGA UAGAGUGAUGAGCUAUCUGAAUGCCAGC |
| 305 | hIL12AB_016 ORF | AUGUGCCACCAGCAGCUGGUCAUCAGCUGGUUCAGCCUGGUCUUCCUGGCCAGCCC CCUGGUGGCCAUCUGGGAGCUGAAGAAGGAUGUUUAUGUUGUGGAGCUGGACUGGU ACCCAGAUGCCCCUGGGGAGAUGGUGGUGCUGACCUGUGACACCCCAGAAGAGGAU GGCAUCACCUGGACCCUGGACCAGAGCUCAGAAGUGCUGGGCAGUGGAAAAACCCU GACCAUCCAGGUGAAGGAGUUUGGAGAUGCUGGCCAGUACACCUGCCACAAGGGGUG |

| SEQ ID NO | Description | Sequence |
|---|---|---|
| | | GUGAAGUGCUGAGCCACAGCCUGCUGCUGCUGCACAAGAAGGAGGAUGGCAUCUGG<br>AGCACAGACAUCCUGAAGGACCAGAAGGAGCCCAAGAACAAGACCUUCCUUCGCUG<br>UGAAGCCAAGAACUACAGUGGCCGCUUCACCUGCUGGUGGCUGACCACCAUCAGCA<br>CAGACCUCACCUUCUCGGUGAAGAGCAGCAGAGGCAGCUCAGACCCCCAGGGUGUC<br>ACCUGUGGGGCGGCCACGCUGUCGGCGGAGAGAGUUCGAGGGGACAACAAGGAGUA<br>UGAAUACUCGGUGGAGUGCCAGGAGGACUCGGCGUGCCCGGCGGCAGAAGAGAGCC<br>UGCCCAUAGAAGUGAUGGUGGAUGCUGUGCACAAGCUGAAGUAUGAAAACUACACC<br>AGCAGCUUCUUCAUCAGAGACAUCAUCAAGCCAGACCCGCCCAAGAACCUGCAGCU<br>GAAGCCCCUGAAGAACAGCAGACAAGUGGAGGUUUCCUGGGAGUACCCAGACACGU<br>GGAGCACCCCCACAGCUACUUCAGCCUGACCUUCUGUGUCCAGGUGCAGGGCAAG<br>AGCAAGAGAGAGAAGAAGGACAGAGUCUUCACAGACAAGACCUCGGCCACGGUCAU<br>CUGCAGAAAGAAUGCCUCCAUCUCGGUUCGAGCCCAGGACAGAUACUACAGCAGCA<br>GCUGGUCAGAAUGGGCCUCGGUGCCCUGCAGUGGUGGCGGCGGCGGCAGCAGA<br>AACCUGCCUGUUGCCACCCCAGACCCUGGGAUGUUCCCCUGCCUGCACCACAGCCA<br>GAACUUAUUACGAGCUGUUUCUAACAUGCUGCAGAAGGCCAGACAAACCCUGGAGU<br>UCUACCCCUGCACCUCAGAAGAGAUUGACCAUGAAGACAUCACCAAGGACAAGACC<br>AGCACUGUAGAGGCCUGCCUGCCCCUGGAGCUGACCAAGAAUGAAAGCUGCCUGAA<br>CAGCAGAGAGACCAGCUUCAUCACCAAUGGAAGCUGCCUGGCCAGCAGAAAGACCA<br>GCUUCAUGAUGGCCCUGUGCCUGAGCAGCAUCUAUGAAGACCUGAAGAUGUACCAG<br>GUGGAGUUCAAGACCAUGAAUGCAAAGCUGCUGAUGGACCCCAAGAGACAAAUAUU<br>UUUGGACCAGAACAUGCUGGCUGUCAUUGAUGAGCUGAUGCAGGCCCUGAACUUCA<br>ACUCAGAAACUGUACCCCAGAAGAGCAGCCUGGAGGAGCCAGACUUCUACAAGACC<br>AAGAUCAAGCUGUGCAUCCUGCUUCAUGCUUUCAGAAUCAGAGCUGUCACCAUUGA<br>CCGCGUGAUGAGCUACUUAAAUGCCUCG |
| 306 | hIL12AB_017 ORF | AUGUGCCACCAGCAGCUGGUAAUCAGCUGGUUUCCCUCGUCUUUCUGGCAUCACC<br>CCUGGUGGCUAUCUGGGAGCUGAAGAAGGACGUGUACGUGGUGGAGCUGGAUUGGU<br>ACCCUGACGCCCCGGGGGAAAUGGUGGUGUUAACAUGCGACACGCCUGAGGAGGAC<br>GGCAUCACCUGGACACUGGACCAGAGCAGCGAGGUGCUUGGGUCUGGUAAAACUCU<br>GACUAUUCAGGUGAAAGAGUUCGGGGAUGCCGGCCAAUAUACUUGCCACAAGGGUG<br>GCGAGGUGCUUUCUCAUUCUCUGCUCCUGCUGCACAAGAAAGAAGAUGGCAUUUGG<br>UCUACUGAUAUUCUGAAAGACCAGAAGGAGCCCAAGAACAAGACCUUUCUGAGAUG<br>CGAGGCUAAAAACUACAGCGGAAGAUUUACCUGCUGGUGGCUGACCACAAUCUCAA<br>CCGACCUGACAUUUUCAGUGAAGUCCAGCAGAGGGAGCUCCGACCCUCAGGGCGUG<br>ACCUGCGGAGCCGCCACUCUGUCCGCAGAAAGAGUGAGAGGUGAUAAUAAGGAGUA<br>CGAGUAUUCAGUCGAGUGCCAAGAGGACUCUGCCUGCCCAGCCGCCUGAGGAGAGCC<br>UGCCAAUCGAGGUGAUGGUAGAUGCGGUACACAAGCUGGAAGUAUGAGAACUACACA<br>UCCUCCUUCUUCAUAAGAGACAUUAUCAAGCCUGACCCACCUAAAAAUCUGCAACU<br>CAAGCCUUUGAAAAAUUCAAGACAGGUGGAGGUGAGCUGGGAGUACCCUGAUACUU<br>GGAGCACCCCCCAUAGCUACUUUUCGCUGACAUUCUGCGUCCAGGUGCAGGGCAAG<br>UCAAAGAGAGAGAAGAAGGAUCGCGUGUUCACUGAUAAGACAAGCGCCACAGUGAU<br>CUGCAGAAAAAACGCUAGCAUUAGCGUCAGAGCACAGGACCGGUAUUACUCCAGCU<br>CCUGGAGCGAAUGGGCAUCUGUGCCCUGCAGCGGUGGGGGCGGAGGCGGAUCUAGA<br>AACCUCCCCGUUGCCACACCUGAUCCUGGAAUGUUCCCCUGUCUGCACCACAGCCA<br>GAACCUGCUGAGAGCAGUGUCAACAUGCUCCAGAAGGCCAGGCAGACCCUGGAGU<br>UUUACCCCUGCACCAGCGAGGAAAUCGAUCACGAGGACAUCACCAAAGAUAAAACC<br>UCCACCGUGGAGGCCUGCCUGCCCCUGGAACUGACCAAAAACGAGAGCUGCCUGAA<br>UAGCAGGGAGACCUCCUUCAUCACCAACGGCUCAUGCCUUGCCAGCCGGAAAACUA<br>GCUUCAUGAUGGCCCUGUGCCUGUCUUCGAUCUAUGAGGACCUGAAAAUGUACCAG<br>GUCGAAUUUAAGACGAUGAACGCAAAGCUGCUGAUGGACCCCAAGCGGCAGAUCUU<br>UCUGGACCAGAACAUGCUGGCAGUCAUAGAUGAGUUGAUGCAGGCAUUAAACUUCA<br>ACAGCGAGACCGUGCCUCAGAAGUCCAGCCUCGAGGAGCCAGAUUUUUAUAAGACC<br>AAGAUCAAACUAUGCAUCCUGCUGCAUGCUUUCAGGAUUAGAGCCGUCACCAUCGA<br>UCGAGUCAUGUCUUACCUGAAUGCUAGC |
| 307 | hIL12AB_018 ORF | AUGUGUCACCAACAGUUAGUAAUCUCCUGGUUUUCUCUGGUGUUUCUGGCCAGCCC<br>CCUCGUGGCCAUCUGGGAGCUUAAAAAGGAUGUGUACGUGGUGGAGCUGGACUGGU<br>AUCCCGAUGCACCAGGCGAAAUGGUCGUGCUGACCUGCGAUACCCCUGAAGAAGAU<br>GGCAUCACCUGGACUCUGGACCAGUCUUCCGAGGUGCUGGAUCUGGCAAGACUCU<br>GACAAUACAAGUUAAGGAGUUCGGGGACGCAGGACAGUACACCUGCCACAAAGGCG<br>GCGAGGUCCUGAGUCACUCCCUGUUACUGCUCCACAAGAAAGAGGACGGCAUUUGG<br>UCCACCGACAUUCUGAAGGACCAGAAGGAGCCUAAGAAUAAAACUUUCCUGAGAUG<br>CGAGGCAAAAAACUAUAGCGGCCGCUUUACUUGCUGGUGGCUUACAACAAUCUCUA<br>CCGAUUUAACUUUCUCCGUGAAGUCUAGCAGAGGAUCCUCUGACCCGCAAGGAGUG<br>ACUUGCGGAGCCGCCACCUUGAGCGCCGAAAGAGUCCGUGGCGAUAACAAGAAUA<br>CGAGUACUCCGUGGAGUGCCAGGAAGAUUCCGCCUGCCCAGCUGCCGAGGAGUCCC<br>UGCCCAUUGAAGUGAUGGUGGAUGCCGUCCACAAGCUGAAGUACGAAAACUAUACC<br>AGCAGCUUCUUCAUCCGGGAUAUCAUUAAGCCCGACCCUCCUAAAAACCUGCAACU<br>UAAGCCCCUAAAGAAUAGUCGGCAGGUUGAGGUCAGCUGGGAAUAUCCUGACACAU<br>GGAGCACCCCCACUCUUUAUUUCUCCCUGACCUUCUGCGUGCAGGUGCAGGGCAAG<br>AGUAAACGGGAGAAAAAGGACAGGGUCUUUACCGAUAAAACCAGCGCUACGGUUAU<br>CUGUCGGAAGAACGCUUCCAUCUCCGUCCGCGCUCAGGAUCGUUACUACUCUGCCU<br>CAUGGAGCGAGUGGGCCAGCGUGCCCUGCAGCGGCGGCGGUGGAGGCGGAUCCAGA |

SUMMARY OF SEQUENCES

| SEQ ID NO | Description | Sequence |
|---|---|---|
| | | AAUCUGCCUGUUGCCACACCAGACCCUGGCAUGUUCCCCUGUCUGCAUCAUAGCCA GAACCUGCUCAGAGCCGUGAGCAACAUGCUCCAGAAGGCCAGGCAGACAUUGGAGU UCUACCCCGUGUACAUCUGAGGAAAUCGAUCACGAAGAUAUAACCAAGGACAAAACC UCUACAGUAGAGGCUUGUUUGCCCCUGGAGUUGACCAAAAACGAGAGUUGCCUGAA CAGUCGCGAGACAAGCUUCAUUACUAACGGCAGCUGUCUCGCCUCCAGAAAGACAU CCUUCAUGAUGGCCCUGUGUCUUUCCAGCAUAUACGAAGACCUGAAAAUGUACCAG GUCGAGUUCAAAACAAUGAACGCCAAGCUGCUUAUGGACCCCAAGAGACAGAUCUU CCUCGACCAAAACAUGCUCGCUGUGAUCGAUGAGCUGAUGCAGGCUCUCAACUUCA AUUCCGAAACAGUGCCACAGAAGUCCAGUCUGGAAGAACCCGACUUCUACAAGACC AAGAUUAAGCUGUGUAUUUUGCUGCAUGCGUUUAGAAUCAGAGCCGUGACCAUUGA UCGGGUGAUGAGCUACCUGAACGCCUCG |
| 308 | hIL12AB_019 ORF | AUGUGCCACCAGCAGCUUGUCAUCUCCUGGUUUUCUCUUGUCUUCCUGGCCUCGCC GCUGGUGGCCAUCUGGGAGCUGAAGAAAGAUGUCUAUGUUGUAGAGCUGGACUGGU ACCCAGAUGCUCCUGGAGAAAUGGUGGUUCUCACCUGUGACACUCCUGAAGAAGAU GGCAUCACCUGGACGCUGGACCAAAGCUCAGAAGUUCUUGGCAGUGGAAAAACCCU GACCAUACAAGUAAAAGAAUUUGGGGAUGCUGGCCAGUACACGUGCCACAAAGGAG GAGAAGUUCUCAGCCACAGUUUACUUCUUCACAAGAAAGAAGAUGGCAUCUGG UCCACGGACAUUUAAAAAGACCAGAAGGAGCCCAAGAACAAAACCUUCCUCCGCUG UGAGGCCAAGAACUACAGUGGUCGUUUCACCUGCUGGUGGCUCACCACCAUCUCCA CUGACCUCACCUUCUCUGUAAAAAGCAGCCGUGGGUUCUUCUGACCCCCAAGGAGUC ACCUGUGGGGCUGCCACGCUCUCGGCAGAAAGAGUUCGAGGGGACAACAAGGAAUA UGAAUAUUCUGUGGAAUGUCAAGAAGAUUCUGCCUGCCCGGCGGCAGAAGAAAGUC UUCCCAUAGAAGUCAUGGUGGAUGCUGUUCACAAAUUAAAAUAUGAAAACUACACC AGCAGCUUCUUCAUUCGUGACAUCAUCAAACCAGACCCGCCCAAGAACCUUCAGUU AAAACCUUUAAAAAACAGCAGACAAGUAGAAGUUUCCUGGGAGUACCCGGACACGU GGUCCACGCCGCACUCCUACUUCAGUUUAACCUUCUGUGUACAAGUACAAGGAAAA UCAAAAAGAGAGAAGAAAGAUCGUGUCUUCACUGACAAAACAUCUGCCACGGUCAU CUGCAGGAAGAAUGCCUCCAUCUCGGUUCGAGCCCAGGACCGCUACUACAGCAGCA GCUGGAGUGAGUGGGCAUCUGUUCCCUGCAGUGGUGGCGGCGGCGGCGGCAGCCGC AACCUUCCUGUGGCCACGCCGGACCCUGGCAUGUUCCCGUGCCUUCACCACUCCCA AAAUCUUCUUCGUGCUGUUUCUAACAUGCUGCAGAAGGCGCGCCAAACUUUAGAAU UCUACCCGUGCACUUCUGAAGAAAUAGACCAUGAAGACAUCACCAAAGAUAAAACC AGCACGGUGGAGGCCUGCCUUCCUUUAGAGCUGACCAAGAAUGAAUCCUGCCUCAA CAGCAGAGAGACCAGCUUCAUCACCAAUGGCAGCUGCCUGGCCUCGCGCAAGACCA GCUUCAUGAUGGCGCUGUGCCUUUCUUCCAUCUAUGAAGAUUUAAAGAUGUACCAA GUAGAAUUUAAAACCAUGAAUGCCAAAUUAUUAAUGGACCCCAAAAGACAAAUAUU UUUGGAUCAAAACAUGCUGGCUGUCAUUGAUGAGCUCAUGCAAGCAUUAAACUUCA ACUCAGAAACUGUUCCCCAGAAGUCAUCUUUAGAAGAGCCGGACUUCUACAAAACA AAAAUAAAACUCUGCAUUCUUCUGCAUGCCUUCCGCAUCCGUGCUGUCACCAUUGA CCGUGUCAUGUCCUACUUAAAUGCUUCU |
| 309 | hIL12AB_020 ORF | AUGUGCCACCAGCAGCUGGUGAUCAGCUGGUUCAGCCUGGUGUUCCUGGCUAGCCC UCUGGUGGCCAUCUGGGAGCUGAAGAAGGACGUGUACGUGGUGGAGUUGGACUGGU ACCCCGACGCUCCCGGCGAGAUGGUGGUGCUGACCUGCGACACCCCCGAGGAGGAC GGGAUCACCUGGACCCUGGAUCAGUCAAGCGAGGUGCUGGGAAGCGGCAAGACCCU GACCAUCCAGGUGAAGGAGUUCGGCGACGCCGGCCAAUACACUUGCCACAAGGGAG GCGAGGUGCUGUCCCACUCCCUCCUGCUGCUGCACAAAAAGGAAGACGGCAUCUGG AGCACCGACAUCCUGAAAGACCAGAAGGAGCCUAAGAACAAGACAUUCCUCAGAUG CGAGGCCAAGAAUUACUCCGGGAGAUUCACCUGUUGGUGGCUGACCACCAUCAGCA CAGACCUGACCUUCAGCGUGAAGAGCAGCAGAGGCAGCAGCGACCCCCAGGGCGUG ACCUGUGGCGCCGCCACCCUGAGCGCCGAAAGAGUGCGCGGCGACAACAAGGAGUA CGAGUACUCCGUGGAAUGCCAGGAGGACAGCGCCUGCCCCGCCGCCGAGGAGAGCC UGCCCAUCGAGGUGAUGGUGGACGCCGUCCACAAGCUGAAGUACGAGAACUACACC UCUAGCUUCUUCAUCCGGGACAUCAUCAAGCCCGAUCCCCCCAAGAACCUGCAGCU GAAACCCCUGAAGAACAGCAGACAGGUGGAGGUGAGCUGGGAGUAUCCCGACACCU GGUCCACCCCCACAGCUAUUUUAGCCUGACCUUCUGCGUGCAAGUGCAGGGCAAG AGCAAGAGAGAAGAAGGACCGCGUGUUCACCGACAAAACCAGCGCCACCGUGAU CUGCAGAAAGAACGCCAGCAUCAGCGUGAGGGCCCAGGAUGAUACUACAGUUCCA GCUGGAGCGAGUGGGCCAGCGUGCCCUGCAGCGGCGGCGGCGGGGAGGCUCUAGA AACCUGCCCGUGGCUACCCCCGAUCCGGAAUGUUCCCCUGCCUGCACCACAGCCA GAACCUGCUGAGGGCGGUGUCCAACAUGCUUCAGAAGGCCCGGCAGACCCUGGAGU UCUACCCCUGUACCUCUGAGGAGAUCGAUCAUGAGGACAUCACAAAGGACAAAACC AGCACCGUGGAGGCCUGCCUGCCCCUGGAGCUGACCAAGAACGAGAGCUGCCUGAA CUCCCGCGAGACCAGCUUCAUCACGAACGGCAGCUGCCUGGCCAGCAGGAAGACCU CCUUCAUGAUGGCCCUGUGCCUGAGCAGCAUCUACGAGGACCUGAAAAUGUACCAG GUGGAGUUUAAGACCAUGAACGCCAAGCUGCUGAUGGACCCCAAGCGGCAAAUCUU CCUGGACCAGAACAUGCUGGCAGUGAUCGACGAGCUCAUGCAGGCCCUGAACUUCA AUAGCGAGACAGUCCCCCAGAAGAGCAGCCUGGAGGAGCCCGACUUUUACAAGACC AAGAUCAAGCUGUGCAUCCUGCUGCACGCCUUUAGAAUCCGUGCCGUGACCAUUGA CAGAGUGAUGAGCUACCUGAAUGCCAGC |

SUMMARY OF SEQUENCES

| SEQ ID NO | Description | Sequence |
|---|---|---|
| 310 | hIL12AB_021 ORF | AUGUGCCACCAGCAGCUGGUGAUCAGCUGGUUCAGCCUGGUGUUCCUGGCCAGCCC UCUGGUUGCCAUCUGGGAGCUGAAGAAAGACGUGUACGUCGUGGAACUGGACUGGU AUCCGGACGCCCCGGGCGAGAUGGUGGUGCUGACCUGUGACACCCCCGAGGAGGAC GGCAUCACCUGGACGCUGGACCAAUCCUCCGAGGUGCUGGGAAGCGGCAAGACCCU GACCAUCCAGGUGAAGGAAUUCGGGGACGCCGGGCAGUACACCUGCCACAAGGGGG GCGAAGUGCUGUCCCACUCGCUGCUGCUCCUGCAUAAGAAGGAGGAUGGAAUCUGG UCCACCGACAUCCUCAAAGAUCAGAAGGAGCCCAAGAACAAGACGUUCCUGCGCUG UGAAGCCAAGAAUUAUUCGGGGCGAUUCACGUGCUGGUGGCUGACAACCAUCAGCA CCGACCUGACGUUUAGCGUGAAGAGCAGCAGGGGGUCCAGCGACCCCCAGGGCGUG ACGUGCGGCGCCGCCACCCUCUCCGCCGAGAGGGUGCGGGGGGACAAUAAGGAGUA CGAGUACAGCGUGGAAUGCCAGGAGGACAGCGCCUGCCCCGCCGCGGAGGAAAGCC UCCCGAUAGAGGUGAUGGUGGACGCCGUGCACAAGCUCAAGUAUGAGAAUUACACC AGCAGCUUUUUCAUCCGGGACAUUAUCAAGCCCGACCCCCCGAAGAACCUCCAGCU GAAGCCCCUGAAGAACAGCCGGCAGGUGGAAGUCUCCUGGGAGUAUCCCGACACCU GGAGCACCCCGCACAGCUACUUCUCCCUGACCUUCUGUGUGCAGGUGCAGGGCAAG UCCAAGAGGGAAAAGAAGGACAGGGUUUUCACCGACAAGACCAGCGCGACCGUGAU CUGCCGGAAGAACGCCAGCAUAAGCGUCCGCGCCCAAGAUAGGUACUACAGCAGCU CCUGGAGCGAGUGGGCUAGCGUGCCCUGCAGCGGGGCGGGGUGGGGCUCCAGG AACCUGCCAGUGGCGACCCCCGACCCCGGCAUGUUCCCCUGCCUCCAUCACAGCCA GAACCUGCUGAGGGCCGUCAGCAAUAUGCUGCAGAAGGCCAGGCAGACCCUGGAAU UCUACCCCUGCACGUCGGAGGAGAUCGAUCACGAGGAUAUCACAAAAGACAAGACU UCCACCGUGGAGGCCUGCCUGCCCCUGGAGCUCACCAAGAAUGAGUCCUGUCUGAA CUCCCGGGAAACCAGCUUCAUCACCAACGGGUCCUGCCUGGCCAGCAGGAAGACCA GCUUUAUGAUGGCCCUGUGCCUGUCAGCAUCUACGAGGACCUGAAGAUGUACCAG GUCGAGUUCAAGACAAUGAACGCCAAGCUGCUGAUGGACCCCAAGAGGCAAAUCUU CCUGGACCAGAAUAUGCUUGCCGUCAUCGACGAGCUCAUGCAGGCCCUGAACUUCA ACUCCGAGACCGUGCCCCAGAAGAGCAGCCUGGAGGAGCCCGACUUCUACAAGACC AAGAUCAAGCUGUGCAUCCUGCUGCACGCGUUCAGGAUCCGGGCAGUCACCAUCGA CCGUGUGAUGUCCUACCUGAACGCCAGC |
| 311 | hIL12AB_022 ORF | AUGUGCCAUCAGCAGCUGGUGAUCAGCUGGUUCAGCCUGGUGUUCCUCGCCUCUCC CCUGGUGGCCAUCUGGGAGCUCAAAAAGGACGUGUACGUGGUGGAGCUCGACUGGU ACCCAGACGCCCCCGGGGAGAUGGUGGUGCUGACCUGCGACACCCCCGAAGAAGAC GGCAUCACGUGGACCCUCGACCAGUCCAGCGAGGUGCUGGGGAGCGGGAAGACUCU GACCAUCCAGGUCAAGGAGUUCGGGGACGCCGGGCAGUACACGUGCCACAAGGGCG GCGAAGUCUUUAAGCCACAGCCUGCUCCUGCUGCACAAGAAGGAGGACGGGAUCUGG UCCACAGACAUACUGAAGGACCAGAAGGAGCCGAAGAAUAAAACCUUUCUGAGGUG CGAGGCCAAGAACUAUUCCGGCAGGUUCACGUGCUGGUGGCUUACAACAAUCAGCA CAGACCUGACGUUCAGCGUGAAGUCCAGCCGCGGCAGCAGCGACCCCCAGGGGGUG ACCUGCGGCGCCGCCACCCUGAGCGCCGAGCGGGUGCGCGGGGACAACAAGGAGUA CGAGUACUCCGUGGAGUGCCAGGAAGACAGCGCCUGUCCCGCCGCCGAAGAGAGCC UGCCUAUCGAGGUCAUGGUAGAUGCAGUGCAUAAGCUGAAGUACGAGAACUAUACG AGCAGCUUUUUCAUCGCGACAUCAUCAAGCCCGACCCCCCCAAGAACCUGCAGCU UAAGCCCCUGAAGAAUAGCCGGCAGGUGGAGGUCUCCUGGGAGUACCCCGACACCU GGUCAACGCCCCACAGCUACUUCUCCCUGACCUUUUGUGUCCAAGUCCAGGGAAAG AGCAAGAGGGAGAAGAAAGAUCGGGUGUUCACCGACAAGACCUCCGCCACGGUGAU CUGCAGGAAGAACGCCAGCAUCUCCGUGAGGGCGCAAGACAGGUACUACUCCAGCA GCUGGUCCGAAUGGGCCAGCGUGCCCUGCUCCGGCGGCGGGGGCGGCGGCAGCCGA AACCUACCCGUGGCCACGCCGGAUCCCGGCAUGUUUCCCUGCCUGCACCACAGCCA GAACCUCCUGAGGGCCGUGUCCAACAUGCUGCAGAAGGCCAGGCAGACUCUGGAGU UCUACCCCUGCACGAGCGAGGAGAUCGAUCACGAGGACAUCACCAAGGAUAAGACC AGCACUGUGGAGGCCUGCCUUCCCCUGGAGCUGACCAAGAACGAGAGCUGUCUGAA CUCCAGGGAGACCUCAUUCAUCACCAACGGCUCCUGCCUGGCCAGCAGGAAAACCA GCUUCAUGAUGGCCUUGUGCUCUCAGCUCCAUCUACGAGGACCUGAAGAUGUAUCAG GUCGAGUUCAAGACAAUGAACGCCAAGCUGCUGAUGGACCCCAAAAGGCAGAUCUU CCUGGACCAGAACAUGCUGGCCGUCAUCGACGAGCUGAUGCAGGCCCUGAACUUCA ACAGCGAGACGGUGCCCCAGAAAAGCUCCCUGGAGGAGCCCGACUUCUACAAGACC AAGAUCAAGCUGUGCAUCCUGCUGCACGCCUUCAGGAUCAGGGCAGUGACCAUCGA CCGGGUGAUGUCAUACCUUAACGCCAGC |
| 312 | hIL12AB_023 ORF | AUGUGCCAUCAGCAGCUGGUGAUCUCCUGGUUCAGCCUGGUGUUUCUGGCCUCGCC CCUGGUCGCCAUCUGGGAGCUGAAGAAAGACGUGUACGUCGUCGAACUGGACUGGU ACCCCGACGCCCCGGGGAGAUGGUGGUGCUGACCUGCGACACGCCGAGGAGGAC GGCAUCACCUGGACCCUGGAUCAAAGCAGCGAGGUGCUGGGCAGCGGCAAGACCCU GACCAUCCAAGUGAAGGAAUUCGGCGAUGCCGGCCAGUACACCUGUCACAAGGGGG GCGAGGUGCUCAGCCACAGCCUGCUGCUGCUGCACAAGAAGGAGGAUGGCAUCUGG AGCACCGAUAUCCUGAAGGACCAGAAGGAGCCCAAGAACAAGACGUUCCUGAGGUG CGAGGCCAAGAACUACAGCGGUAGGUUCACGUGUUGGUGGCUGACCACCAUCAGCA CCGACCUGACGUUCAGCGUGAAGAGCUCCAGGGGCAGCUCCGACCCCACAGGGGGUG ACGUGCGGGGCCGCAACCCUCAGCGCCGAAGGGUGCGGGGGGACAACAAGGAGUA CGAAUACUCCGUGGAGUGCCAGGAAGAUUCGGCCUGCCCCGCCGCGGAGGAGAGCC UCCCCAUCGAGGUAAUGGUGGACGCCGUGCAUAAGCUGAAGUACGAGAACUACACC AGCUCGUUCUUCAUCCGAGACAUCAUCAAACCCGACCCGCCCAAAAAUCUGCAGCU |

SUMMARY OF SEQUENCES

| SEQ ID NO | Description | Sequence |
|---|---|---|
| | | CAAGCCCCUGAAGAACUCCAGGCAGGUGGAGGUGAGCUGGGAGUACCCCGACACCU<br>GGUCCACCCCGCACAGCUACUUCUCCCUGACAUUCUGCGUGCAGGUGCAGGGCAAG<br>AGCAAGCGGGAGAAGAAGGACAGGGUGUUCACCGACAAGACGAGCGCCACCGUGAU<br>CUGCCGAAAGAACGCCAGCAUCUCGGUGCGCGCCCAGGAUAGGUACUAUUCCAGCU<br>CCUGGAGCGAGUGGGCCUCGGUACCCUGCAGCGGCGGCGGGGGCGGCGGCAGUAGG<br>AAUCUGCCCGUGGCUACCCCGGACCCGGGCAUGUUCCCCUGCCUCCACCACAGCCA<br>GAACCUGCUGAGGGCCGUGAGCAACAUGCUGCAGAAGGCCAGACAGACGCUGGAGU<br>UCUACCCCUGCACGAGCGAGGAGAUCGACCACGAGGACAUCACCAAGGAUAAAACU<br>UCCACCGUCGAGGCCUGCCUGCCCUUGGAGCUGACCAAGAAUGAAUCCUGUCUGAA<br>CAGCAGGGAGACCUCGUUUAUCACCAAUGGCAGCUGCCUCGCCUCCAGGAAGACCA<br>GCUUCAUGAUGGCCCUCGUCUGAGCUCCAUCUAUGAGGACCUGAAGAUGUACCAG<br>GUGGAGUUCAAGACCAUGAACGCGAAGCUGCUAUGGACCCCAAGAGGCAGAUCUU<br>CCUGGAUCAGAAUAUGCUGGCGGUGAUCGACGAGCUCAUGCAGGCCCUCAAUUUCA<br>AUAGCGAGACAGUGCCCCAGAAGUCCUCCCUGGAGGAGCCCGACUUCUACAAGACC<br>AAGAUCAAGCUGUGUAUCCUGCUGCACGCCUUCCGGAUCCGGGCCGUCACCAUCGA<br>CCGGGUCAUGAGCUACCUCAAUGCCAGC |
| 313 | hIL12AB_024 ORF | AUGUGCCACCAGCAGCUGGUGAUCUCCUGGUUCUCCCUGGUGUUCCUGGCCUCGCC<br>CCUGGUGGCCAUCUGGGAGCUGAAGAAGGACGUGUACGUCGUGGAGCUCGACUGGU<br>ACCCCGACGCCCCUGGCGAGAUGGUGGUGCUGACCUGCGACACCCCCAGAGGAGGAU<br>GGCAUCACCUGGACCCUGGAUCAGUCCUCCGAGGUGCUGGGCUCCGGCAAGACGCU<br>GACCAUCCAAGUGAAGGAGUUCGGUGACGCCGGACAGUAUACCUGCCAUAAGGGCG<br>GCGAGGUCCUGUCCCACAGCCUCCUCCUCCUGCAUAAGAAGGAGGACGGCAUCUGG<br>AGCACCGACAUCCUGAAGGACCAGAAGGAGCCCAAGAACAAGACCUUUCUGAGGUG<br>CGAGGCCAAGAACUACAGCGGCCGAUUCACCUGCUGGUGGCUCACCACCAUAUCCA<br>CCGACCUGACUUUCUCCGUCAAGUCCUCCCGGGGGUCCAGCGACCCCCAGGGAGUG<br>ACCUGCGGCGCCGCCACCCUCAGCGCCGAGCGGGUGCGGGGGGACAACAAGGAGUA<br>CGAAUACUCCGUCGAGUGCCAGGAGGACUCCGCCUGCCCGGCCGCCGAGGAGAGCC<br>UGCCCAUCGAGGUGAUGGUCGACGCGGUGCACAAGCUGAAGUACGAGAACUACACC<br>AGCAGUUUCUUCAUCAGGGAUAUCAUCAAGCCAGAUCCCCCGAAGAAUCUGCAACU<br>GAAGCCGCUGAAAAACUCACGACAGGUGGAGGUGAGCUGGGAGUACCCCGACACGU<br>GGAGCACCCCACAUUCCUACUUCAGCCUGACCUUCUGCGUGCAGGUCCAGGGCAAG<br>AGCAAGCGGGAGAAGAAGGACAGGGUGUUCACGGAUAAGACCAGUGCCACCGUGAU<br>CUGCAGGAAGAACGCCCUCUAUUAGCGUGAGGGCCCAGGAUCGGUAUUACUCCUCGA<br>GCUGGAGCGAAUGGGCCUCCGUGCCCUGCAGUGGGGGGGUGGAGGCGGGAGCAGG<br>AACCUGCCCGUAGCAACCCCCGACCCCGGGAUGUUCCCCUGUCUGCACCACUCGCA<br>GAACCUGCUGCGCGCGGUGAGCAACAUGCUCCAAAAAGCCCGUCAGACCCUUAGAGU<br>UCUACCCCUGCACCAGCGAAGAAAUCGACCACGAAGACAUCACCAAGGACAAAACC<br>AGCACCGUGGAGGCGUGCCUGCCGCUGGAGCUGACCAAGAACGAGAGCUGCCUCAA<br>CUCCAGGGAGACCAGCUUUAUCACCAACGGCUCGUGCCUAGCCAGCCGGAAAACCA<br>GCUUCAUGAUGGCCCUGUGCCUGAGCUCCAUUUACGAGGACCUGAAGAUGUAUCAG<br>GUGGAGUUCAAGACCAUGAAUGCCAAACUCCUGAUGGACCCCAAGAGGCAGAUCUU<br>CCUGGACCAGAACAUGCUCGCGGUGAUCGAUGAGCUGAUGCAGGCCCUGAACUUUA<br>AUAGCGAGACCGUGCCCCAGAAAAGCAGCCUGGAGGAGCCGGACUUCUACAAGACC<br>AAAAUCAAGCUGUGCAUCCUGCUCCACGCCUUCCGCAUCCGGGCCGUGACCAUCGA<br>CAGGGUGAUGAGCUACCUGAACGCCAGC |
| 314 | hIL12AB_025 ORF | AUGUGCCAUCAGCAGCUGGUGAUUUCCUGGUUCUCCCUGGUGUUCCUGGCCAGCCC<br>CCUCGUGGCGAUCUGGGAGCUAAAGAAGGACGUGUACGUGGUGGAGCUGGACUGGU<br>ACCCGGACGCACCCGGCGAGAUGGUCGUUCUGACCUGCGAUACGCCAGAGGAGGAC<br>GGCAUCACCUGGACCCUCGAUCAGAGCAGCGAGGUCCUGGGGAGCGGAAAGACCCU<br>GACCAUCCAGGUCAAGGAGUUCGGCGACGCCGGCCAGUACACCUGCCACAAAGGUG<br>GCGAGGUCCUGAGCCACUCGCUGCUGCUCCUGCAUAAGAAGGAGGACGGAAUCUGG<br>AGCACAGACAUCCUGAAGACCAGAAGGAGCCCAAGAACAAGACCUUCCUGAGGUG<br>CGAGGCCAAGAACUACAGCGGGCGCUUCACGUGCUGGUGGCUGACCACCAUCAGCA<br>CGGACCUCACCUUCUCCGUGAAGAGCAGCCGGGGAUCCAGCGAUCCCCAAGGCGUC<br>ACCUGCGGCGCGGCCACCCUGAGCGCGGAGAGGGUCAGGGGCGAUAAUAAGGAGUA<br>UGAGUACAGCGUGGAGUGCCAGGAGGACAGCGCCUGCCCGGCCGCCGAGGAGUCCC<br>UGCCAAUCGAAGUGAUGGUCGACGCCGUGCACAAGCUGAAGUACGAGAACUACACC<br>AGCAGCUUCUUCAUCCGGGAUAUCAUCAAGCCCGAUCCCCCGAAGAACCUGCAGCU<br>GAAGCCCCUCAAGAACAGCCGGCAGGUGGAGGUGAGUUGGGAGUACCCCGACACCU<br>GGUCAACGCCCCACAGCUACUUCUCCCUGACCUUCUGUGUGCAGGUGCAGGGAAAG<br>AGCAAGAGGGAGAAGAAACCGGGUCUUCACCGACAAGACCAGCGCCACGGUGAU<br>CUGCAGGAAGAACGCAAGCAUCUCCGUGAGGGCCCAGGACAGGUACUACAGCUCCA<br>GCUGGUCCGAAUGGGCCAGCGUGCCCUGUAGCGGCGGCGGGGGCGGUGGCAGCCGC<br>AACCUCCCAGUGGCCACCCCCGACCCCGGCAUGUUCCCCUGCCUGCACCACAGCCA<br>GAAUCUGCUGAGGGCCGUGAGUAACAUGCUGCAGAAGGCAAGGCAAACCCUCGAAU<br>UCUAUCCCUGCACCUCCGAGGAGAUCGACCACGAGGAUAUCACCAAGGACAAGACC<br>AGCACCGUCGAGGCCUGUCUCCCCCUGGAGCUGACCAAGAAUGAGAGCUGCCUGAA<br>CAGCCGGGAGACCAGCUUCAUCACCAACGGGAGCUGCCUGGCCUCCAGGAAGACCU<br>CGUUCAUGAUGGCGCUGUGCCUCUCAAGCAUAUACGAGGAUCUGAAGAUGUACCAG<br>GUGGAGUUUAAGACGAUGAACGCCAAGCUGCUAUGGACCCGAAGAGGCAGAUCUU<br>CCUGGACCAGAACAUGCUGGCCGUGAUAGACGAGCUCAUGCAGGCCCUGAACUUCA |

SUMMARY OF SEQUENCES

| SEQ ID NO | Description | Sequence |
|---|---|---|
| | | ACUCCGAGACCGUGCCGCAGAAGUCAUCCCUCGAGGAGCCCGACUUCUAUAAGACC<br>AAGAUCAAGCUGUGCAUCCUGCUCCACGCCUUCCGGAUAAGGGCCGUGACGAUCGA<br>CAGGGUGAUGAGCUACCUUAACGCCAGC |
| 315 | hIL12AB_026 ORF | AUGUGCCACCAGCAGCUCGUGAUCAGCUGGUUCUCCCUGGUGUUUCUCGCCAGCCC<br>CCUGGUGGCCAUCUGGGAGCUGAAGAAGGACGUGUACGUGGUGGAGCUGGACUGGU<br>ACCCUGACGCCCCGGGGGAGAUGGUCGUGCUGACCUGCGACACCCCCGAAGAGGAC<br>GGUAUCACCUGGACCCUGGACCAGUCCAGCGAGGUGCUGGGCAGCGGCAAGACCCU<br>GACUAUUCAAGUCAAGGAGUUCGGAGACGCCGGCCAGUACACCUGCCACAAGGGUG<br>GAGAGGUGUUAUCACACAGCCUGCUGCUGCUGCACAAGAAGGAAGACGGGAUCUGG<br>AGCACCGACAUCCUGAAGGACCAGAAGGAGCCCAAAAACAAGACCUUCCUGCGGUG<br>CGAGGCCAAGAACUAUUCGGGCCGCUUUACGUGCUGGUGGCUGACCACCAUCAGCA<br>CUGAUCUCACCUUCAGCGUGAAGUCCUCCCGGGGGUCGUCCGACCCCCAGGGGGUG<br>ACCUGCGGGCCGCCACCCUGUCCGCCGAGAGAGUGAGGGGCGAUAAUAAGGAGUA<br>CGAGUACAGCGUUGAGUGCCAGGAAGAUAGCGCCUGUCCCGCCGCCGAGGAGAGCC<br>UGCCCAUCGAGGUGAUGGUGGACGCCGUCCACAAGCUGAAGUAUGAGAACUACACC<br>UCAAGCUUCUUCAUCAGGGACAUCAUCAAACCCGAUCCGCCCAAGAAUCUGCAGCU<br>GAAGCCCCUGAAAAAUAGCAGGCAGGUGGAGGUGAGCUGGGAGUACCCCGACACCU<br>GGUCCACCCCCCAUAGCUAUUUCUCCCUGACGUUCUGCGUGCAGGUGCAAGGGAAG<br>AGCAAGCGGGAGAAGAAGGACCGGGUGUUCACCGACAAGACCUCCGCCACCGUGAU<br>CUGUAGGAAGAACGCGUCGAUCUCGGUCAGGGCCCAGGACAGGUAUUACAGCAGCA<br>GCUGGAGCGAGUGGGCGAGCGUGCCCUGCUCGGGCGGCGGCGGCGGGGAGCAGA<br>AAUCUGCCCGUGGCCACCCCAGACCCCGGAAUGUUCCCCUGCCUGCACCAUUCGCA<br>GAACCUCCUGAGGGCCGUGAGCAACAUGCUGCAGAAGGCCCGCCAGACGCUGGAGU<br>UCUACCCCUGCACGAGCGAGGAGAUCGACCACGAAGACAUCACCAAGGACAAAACC<br>AGCACCGUGGAGGCCUGCCUGCCCCUGGAGCUGACCAAAAACGAAUCCUGCCUCAA<br>CAGCCGGGAGACCAGCUUCAUCACCAACGGCAGCUGCCUGGCCAGCCGAAAGACCU<br>CCUUCAUGAUGGCCCUCUGCCUGAGCAGCAUCUAUGAGGAUCUGAAGAUGUAUCAG<br>GUGGAGUUCAAGACCAUGAAUGCCAAGCUGCUGAUGGACCCCAAGAGGCAGAUAUU<br>CCUGGACCAGAAUAUGCUGGCCGUGAUCGACGAGCUGAUGCAGGCCCUGAACUUCA<br>ACAGCGAGACCGUCCCCCAGAAGUCCAGCCUGGAGGAGCCGGACUUUUACAAAACG<br>AAGAUCAAGCUGUGCAUACUGCUGCACGCCUUCAGGAUCCGGGCCGUGACAAUCGA<br>CAGGGUGAUGUCCUACCUGAACGCCAGC |
| 316 | hIL12AB_027 ORF | AUGUGUCACCAGCAGCUGGUGAUCAGCUGGUUCUCCCUGGUGUUCCUGGCCAGCCC<br>CCUGGUGGCCAUCUGGGAGCUCAAGAAGGACGUCUACGUCGUGGAGCUGGAUUGGU<br>ACCCCGACGCUCCCGGGGAGAUGGUGGUGCUGACCUGCGACACCCCCGAGGAGGAC<br>GGCAUCACCUGGACGCUGGACCAGAGCUCAGAGGUGCUGGGAAGCGGAAAGACACU<br>GACCAUCCAGGUGAAGGAGUUCGGGGAUGCCGGGCAGUAUACCUGCCACAAGGGCG<br>GCGAAGUGCUGAGCCAUUCCCUGCUGCUGCUGCACAAGAAGGAGGACGGCAUAUGG<br>UCCACCGACAUCCUGAAGGAUCAGAAGGAGCCGAAGAAUAAAACCUUCCUGAGGUG<br>CGAGGCCAAGAAUUACAGCGGACCGAUUCACCUGCUGGUGGCUGACCACCAUCAGCA<br>CCGACCUGACCUUCAGUGUGAAGUCCUCACGGGGCAGCUCAGAUCCCCAGGGCGUG<br>ACCUGCGGGCCGCGACACUCAGCGCCGAGCGGGUGAGGGGUGAUAACAAGGAGUA<br>CGAGUAUUCUGUGGAGUGCCAGGAAGACUCCGCUGUCCCGCCGCCGAGGAGUCCC<br>UGCCCAUCGAGGUGAUGGUGGACGCCGUGCAUAAACUGAAGUACGAGAACUACACC<br>UCCAGCUUCUUCAUCCGGGAUAUAAUCAAGCCCGACCCUCCGAAAAACUGCAGCU<br>GAAGCCCCUUAAAAACAGCCGGCAGGUGGAGGUGAGCUGGGAGUACCCCGACACCU<br>GGAGCACCCCCCAUAGCUAUUUCAGCCUGACCUUCUGCGUGCAGGUGCAGGGGAAG<br>UCCAAGCGCGAGAAAAAGGACCGGGUGUUCACCGACAAGACGAGCGCCACCGUGAU<br>CUGCCGGAAGAACGCCAGUAUAAGCGUAAGGGCCCAGGAUAGGUACUACAGCUCCA<br>GCUGGUCGAGUGGGCCUCCGUGCCCUGUUCCGGCGGCGGGGGGGUGGCAGCAGG<br>AACCUCCCCGUGGCCACGCCGGACCCCGGCAUGUUCCCGUGCCUGCACCACUCCCA<br>AAACCUCCUGCGGGCCGUCAGCAACAUGCUGCAAAAGGCGCGGCAGAGACCCGGAGU<br>UUUACCCCUGUACCUCCGAAGAGAUCGACCACGAGGAUAUCACCAAGGAUAAGACC<br>UCCACCGUGGAGGCCUGUCUCCCCCUGGAGCUGACCAAGAACGAGAGCUGUCUUAA<br>CAGCAGAGAGACCUCGUUCAUAACGAACGGCUCCUGCCUCGCUUCCAGGAAGACGU<br>CGUUCAUGAUGGCGCUGUGCCUGUCCAGCAUCUACGAGGACCUGAAGAUGUAUCAG<br>GUCGAGUUCAAAACCAUGAAUGCCAAGCUGCUGAUGGACCCCAAGAGGCAGAUCUU<br>CCUGGACCAGAACAUGCUCGCCGUGAUCGACGAGCUGAUGCAGGCCCUGAACUUCA<br>ACAGCGAAACCGUGCCCCAGAAGUCAAGCCUGGAGGAGCCGGACUUCUAUAAGACC<br>AAGAUCAAGCUGUGUAUCCUGCUACACGCUUUUCGUAUCCGGGCCGUGACCAUCGA<br>CAGGGUUAUGUCGUACUUGAACGCCAGC |
| 317 | hIL12AB_028 ORF | AUGUGCCACCAACAGCUCGUGAUCAGCUGGUUCAGCCUGGUGUUCCUGGCCAGCCC<br>GCUGGUGGCCAUCUGGGAGCUGAAGAAGGACGUGUACGUGGUGGAGCUGGACUGGU<br>ACCCCGACGCCCCCGGCGAGAUGGUGGUCCUGACCUGCGACACGCCGAAGAGGAC<br>GGCAUCACCUGGACCCUGGAUCAGUCCAGCGAGGUGCUGGGCUCCGGCAAGACCCU<br>GACCAUUCAGGUGAAGGAGUUCGGCGACGCCGGUCAGUACACCUGCCACAAGGGCG<br>GCGAGGUGCUGAGCCACAGCUACUGCUCCUGCACAAAAAGGAGGAUGGAAUCUGG<br>UCCACCGACAUCCUCAAGGACCAGAAGGAGCCGAAGAACAAGACGUUCCUCCGGUG<br>CGAGGCCAAGAACUACAGCGGCAGGUUUACCUGCUGGUGGCUGACCACCAUCAGCA<br>CCGACCUGACAUUUUCCGUGAAGAGCAGCCGCGGCAGCAGCGAUCCCCAGGGCGUG |

| SEQ ID NO | Description | Sequence |
|---|---|---|
| | | ACCUGCGGGGCGGCCACCCUGUCCGCCGAGCGUGUGAGGGGCGACAACAAGGAGUA<br>CGAGUACAGCGUGGAAUGCCAGGAGGACAGCGCCUGUCCCGCCGCCGAGGAGAGCC<br>UGCCAAUCGAGGUCAUGGUGGACGCCGUGCACAAGCUGAAGUACGAGAACUACACG<br>AGCAGCUUCUUCAUCAGGGACAUCAUCAAACCGGACCCGCCCAAGAACCUGCAGCU<br>GAAACCCUUGAAAAACAGCAGGCAGGUGGAAGUGUCUUGGGAGUACCCGACACCU<br>GGUCCACCCCCACAGCUACUUUAGCCUGACCUUCUGUGUGCAGGUCCAGGGCAAG<br>UCCAAGAGGGAGAAGAAGGACAGGGUGUUCACCGACAAAACCAGCGCCACCGUGAU<br>CUGCAGGAAGAACGCCUCCAUCAGCGUGCGGGCCCAGGACAGGUAUUACAGCUCGU<br>CGUGGAGCGAGUGGGCCAGCGUGCCCUGCUCCGGGGGAGGCGGCGGCGAAGCCGG<br>AAUCUGCCCGUGGCCACCCCCGAUCCCGGCAUGUUCCCGUGUCUGCACCACAGCCA<br>GAACCUGCUGCGGGCCGUGAGCAACAUGCUGCAGAAGGCCCGCCAAACCCUGGAGU<br>UCUACCCCUGUACAAGCGAGGAGAUCGACCAUGAGGACAUUACCAAGGACAAGACC<br>AGCACCGUGGAGGCCUGCCUGCCCCUCGAGCUCACAAAGAACGAAUCCUGCCUGAA<br>UAGCCGCGAGACCAGCUUUAUCACGAACGGGUCCUGCCUCGCCAGCCGGAAGACAA<br>GCUUCAUGAUGGCCCUGUGCCUGAGCAGCAUCUACGAGGACCUGAAAAUGUACCAA<br>GUGGAGUUCAAAACGAUGAACGCCAAGCUGCUGAUGGACCCCAAGCGCCAGAUCUU<br>CCUGGACCAGAACAUGCUGGCCGUCAUCGACGAGCUCAUGCAGGCCCUGAACUUCA<br>ACAGCGAGACCGUGCCCCAGAAGAGCAGCCUGGAGGAGCCCGACUUCUACAAGACG<br>AAGAUCAAGCUCUGCAUCCUGCUGCACGCUUUCCGCAUCCGCGCGGUGACCAUCGA<br>CCGGGUGAUGAGCUACCUCAACGCCAGU |
| 318 | hIL12AB_029 ORF | AUGUGCCACCAACAGCUGGUGAUCAGCUGGUUCAGCCUGGUGUUUCUGGCCUCCCC<br>UCUGGUGGCCAUCUGGGAGCUGAAGAAGGACGUGUACGUGGUGGAGCUGGACUGGU<br>ACCCUGACGCCCCCGGCGAAAUGGUGGUGCUGACGUGCGACACCCCCGAGGAGGAU<br>GGCAUCACCUGGACCCUGGACCAAAGCAGCGAGGUCCUCGGAAGCGGCAAGACCCU<br>CACUAUCCAAGUGAAGGAGUUCGGGGAUGCGGCCAGUACACCCUGCACAAGGGCG<br>GCGAGGUGCUGUCUCAUAGCCUGCUGCUCCUGCAUAAGAAGGAAGACGGCAUCUGG<br>AGCACCGACAUACUGAAGGAUCAGAAGGAGCCCAAGAACAAGACCUUCCUGAGGUG<br>CGAGGCCAAGAACUACUCCGGGCGCUUCACCUGUUGGUGGCUGACCACCAUCUCCA<br>CCGACCUGACCUUCAGCGUGAAGAGCAGCAGGGGGAGCAGCGACCCCCAGGGGGUG<br>ACCUGCGGAGCCGCGACCUUGUCGGCCGAGCGGGUGAGGGGCGACAAUAAGGAGUA<br>CGAGUACUCGGUCGAAUGCCAGGAGGACUCCGCCUGCCCCGCCGCCGAGGAGUCCC<br>UCCCCAUCGAAGUGAUGGUGGACGCCGUCCACAAGCUGAAGUACGAGAACUACACC<br>AGCAGCUUCUUCAUCGGGAUAUCAUCAAGCCCGACCCCCCGAAGAACCUGCAGCU<br>GAAACCCUUGAAGAACUCCAGGCAGGUGGAGGUGAGCUGGGAGUACCCCGACACCU<br>GGUCCACCCCGCACUCAUACUUCAGCCUGACCUUCUGUGUACAGGUCCAGGGCAAG<br>AGCAAGAGGGAAAAGAAGGAUAGGGUGUUCACCGACAAGACCUCCGCCACGGUGAU<br>CUGUCGGAAAAACGCCAGCAUCUCCGUGCGGGCCCAGGACAGGUACUAUUCCAGCA<br>GCUGGAGCGAGUGGGCCUCCGUCCCCUGCUCCGGCGGCGGUGGCGGGGGCAGCAGG<br>AACCUCCCCGUGGCCACCCCCGAUCCCGGGAUGUUCCCAUGCCUGCACCACAGCCA<br>AAACCUGCUGAGGGCCGUCUCCAAUAUGCUGCAGAAGGCGAGGCAGACCCUGGAGU<br>UCUACCCCUGUACCUCCGAGGAGAUCGACCACGAGGAUAUCACCAAGGACAAGACC<br>UCCACGGUCGAGGCGUGCCUGCCCCUGGAGCUCACGAAGAACGAGAGCUGCCUUAA<br>CUCCAGGGAAACCUCGUUUAUCACGAACGGCAGCUGCCUGGCGUCACGGAAGACCU<br>CCUUUAUGAUGGCCCUAUGUCUGUCCCUCGAUCUACGAGGACCUGAAGAUGUACCAG<br>GUGGAGUUCAAGACCAUGAACGCCAAGCUGCUGAUGGAUCCCAAGAGGCAGAUUUU<br>CCUGGACCAGAACAUGCUGGCCGUGAUUGACGAGCUGAUGCAGGCGCUGAACUUCA<br>ACAGCGAGACAGUGCCGCAGAAGAGCUCCCUGGAGGAGCCGGACUUUUACAAGACC<br>AAGAUAAAGCUGUGCAUCCUGCUCCACGCCUUCAGAAUACGGGCCGUCACCAUCGA<br>UAGGGUGAUGUCUUACCUGAACGCCUCC |
| 319 | hIL12AB_030 ORF | AUGUGCCACCAGCAGCUGGUGAUUAGCUGGUUUAGCCUGGUGUUCCUGGCAAGCCC<br>CCUGGUGGCCAUCUGGGAACUGAAAAAGGACGUGUACGUGGUCGAGCUGGAUUGGU<br>ACCCCGACGCCCCCGGCGAAAUGGUGGUGCUGACGUGUGAUACCCCCGAGGAGGAC<br>GGGAUCACCUGGACCCUGGAUCAGAGCAGCGAGGUGCUGGGGAGCGGGAAGACCCU<br>GACGAUCCAGGUCAAGGAGUUCGGCGACGCUGGGCAGUACACCCUGUCACAAGGGCG<br>GGGAGGUGCUGUCCCACUCCCUGCUGCUCCUGCAUAAGAAAGAGGACGGCAUCUGG<br>UCCACCGACAUCCUCAAGGACCAGAAGGAGCCCAAGAACAAGACCUUCCUGCGGUG<br>UGAGGCGAAGAACUACAGCGGCCGUUUCACCUGCUGGUGGCUGACGACAAUCAGCA<br>CCGACUUGACGUUCUCCGUGAAGUCCUCCAGAGGCAGCUCCGACCCCCAAGGGGUG<br>ACGUGCGGCGCGGCCACCCUGAGCGCCGAGCGGGUGCGGGGGGACAACAAGGAGUA<br>CGAGUACUCCGUGGAGUGCCAGGAGGACAGCGCCUGUCCCGCAGCCGAGGAGUCCC<br>UGCCCAUCGAAGUCAUGGUGGACGCCGUCCACAAGCUGAAGUACGAGAACUACACC<br>AGCAGCUUCUUCAUCCGCGAUAUCAUCAAGCCCGAUCCCCCCAAAAACCUGCAACU<br>GAAGCCGCUGAAGAAUAGCAGGCAGGUGGAGGUGUCCUGGGAGUACCCGGACACCU<br>GGAGCACGCCCCACAGCUAUUUCAGCCUGACCUUUUGCGUGCAGGUCCAGGGGAAG<br>AGCAAGCGGGAGAAGAAGGACCGCGUGUUUACGGACAAAACCAGCGCCACCGUGAU<br>CUGCAGGAAGAACGCCAGCAUCAGCGUGAGGGCCCAGGACAGGUACUACAGCAGCU<br>CCUGGAGCGAGUGGGCCUCCGUGCCCUGUUCCGGAGGCGGCGGGGGCGGUUCCCGG<br>AACCUCCCGGUGGCCACCCCCGACCCGGGCAUGUUCCCGUGCCUGCACCACUCACA<br>GAAUCUGCUGAGGGCCGUGAGCAAUAUGCUGCAGAAGGCAAGGCAGACCCUGGAGU<br>UUUAUCCCUGCACCAGCGAGGAGAUCGACCACGAAGACAUCACCAAGGACAAGACC<br>AGCACAGUGGAGGCCUGCCUGCCCCUGGAACUGACCAAGAACGAGAGUCCUGUCUGAA |

SUMMARY OF SEQUENCES

| SEQ ID NO | Description | Sequence |
|---|---|---|
| | | CUCCCGGGAAACCAGCUUCAUAACCAACGGCUCCUGUCUCGCCAGCAGGAAGACCA GCUUCAUGAUGGCCCUGUGCCUCAGCUCCAUCUACGAGGACCUCAAGAUGUACCAG GUUGAGUUCAAGACCAUGAACGCCAAGCUCCUGAUGGACCCCAAGAGGCAGAUCUU CCUGGACCAGAAUAUGCUGGCCGUGAUCGAUGAGUUAAUGCAGGCGCUGAACUUCA ACAGCGAGACGGUGCCCAAAAGUCCUCGCUGGAGGAGCCCGACUUCUACAAGACC AAGAUCAAGCUGUGCAUCCUCCUGCACGCCUUCCGAAUCCGGGCCGUAACCAUCGA CAGGGUGAUGAGCUAUCUCAACGCCUCC |
| 320 | hIL12AB_031 ORF | AUGUGCCACCAGCAGCUCGUGAUCAGCUGGUUCUCGCUUGUGUUCCUGGCCUCCCC CCUCGUCGCCAUCUGGGAGCUGAAGAAAGACGUGUACGUGGUGGAGCUGGACUGGU AUCCCGACGCCCCCGGGGAGAUGGUGGUGCUGACCUGCGACACCCCGGAAGAGGAC GGCAUCACCUGGACGCUCGACCAGUCGUCCGAAGUGCUGGGGUCGGGCAAGACCCU CACCAUCCAGGUGAAGGAGUUCGGAGACGCCGGCCAGUACACCUGUCAUAAGGGGG GGGAGGUGCUGAGCCACAGCCUCCUGCUCCUGCACAAAAAGGAGGACGGCAUCUGG AGCACCGAUAUCCUCAAGGACCAGAAGGAGCCCAAGAACAAGACGUUCCUGAGGUG UGAGGCCAAGAACUACAGCGGGCGGUUCACGUGUUGGUGGCUCACCACCAUCUCCA CCGACCUCACCUUCUCCGUGAAGUCAAGCAGGGGCAGCUCCGACCCCCAAGGCGUC ACCUGCGGCGCCGCCACCCUGAGCGCCGAGAGGGUCAGGGGGGAUAACAAGGAAUA CGAGUACAGUGUGGAGUGCCAAGAGGAUAGCGCCCUGUCCCGCCGCCAAGAGAGCC UGCCCAUCGAAGUGAUGGUGGACGCCGUGCACAAGCUGAAGUACGAGAACUACACC UCCAGCUUCUUCAUCAGGGAUAUCAUCAAGCCCGAUCCCCCCAAGAACCUGCAGCU GAAGCCCCUGAAGAACAGCAGGCAGGUGGAGGUGAGCUGGGAGUAUCCCGACACGU GGAGCACCCCGCACAGCUACUUCUCGCUGACCUUCUGCGUGCAGGUGCAAGGGAAG UCCAAGAGGGAGAAGAAGGAUAGGGUGUUCACCGACAAAACGAGCGCCACCGUGAU CUGCCGGAAGAAUGCCAGCAUCUCUGUGAGGGCCCAGGACAGGUACUAUUCCAGCU CCUGGUCGGAGUGGGCCAGCGUGCCCUGUAGCGGCGGGGGCGGGGCGGCAGCAGG AACCUCCCGGUUGCCACCCCCGACCCCGGCAUGUUUCCGUGCCUGCACCACUCGCA AAACCUGCUGCGCGCGGUCUCCAACAUGCUGCAAAAAGCGCGCCAGACGCUGGAGU UCUACCCCUGCACCAGCGAGGAGAUCGAUCAUGAAGAUAUCACCAAAGACAAGACC UCGACCGUGGAGGCCUGCCUGCCCCUGGAGCUCACCAAGAACGAAAGCUGCCUGAA CAGCAGGGAGACAAGCUUCAUCACCAACGGCAGCUGCCUGGCCUCCCGGAAGACCA GCUUCAUGAUGGGCCCUGUGCCUGUCCAGCAUCUACGAGGAUCUGAAGAUGUACCAA GUGGAGUUUAAGACCAUGAACGCCAAGCUGUUUAAUGGACCCCAAAAGGCAGAUCUU CCUGGAUCAGAACAUGCUGGCCGUCAUCGACGAGCUGAUGCAAGCCCUGAACUUCA ACAGCGAGACGGUGCCCCAGAAGAGCAGCCUCGAGGAGCCCGACUUCUAUAAGACC AAGAUAAAGCUGUGCAUUCUGCUGCACGCCUUCAGAAUCAGGGCCGUGACCAUCGA UAGGGUGAUGAGCUACCUGAACGCCAGC |
| 321 | hIL12AB_032 ORF | AUGUGUCACCAGCAGCUGGUGAUUUCCUGGUUCAGUCUGGUGUUUCUUGCCAGCCC CCUGGUGGCCAUCUGGGAGCUGAAGAAAGACGUAUACGUCGUGGAGCUGGACUGGU AUCCCGACGCUCCCCGGCGAGAUGGUGGUCCUCACCUGCGACACCCCAGAGGAGGAC GGCAUCACCUGGACCCUGGACCAGAGCUCCGAGGUCCUGGGCAGCGGUAAGACCCU CACCAUCCAGGUGAAGGAGUUUGGUGAUGCCGGGCAGUAUACCUGCCACAAGGGCG GCGAGGUGCUGUCCCACAGCCUCCUGUUACUGCAUAAGAAGGAGGAUGGCAUCUGG AGCACCGACAUCCUCAAGGACCAGAAAGAGCCCAAGAACAAGACCUUUCUGCGGUG CGAGGCGAAAAAUUACUCCGGCCGGUUCACCUGCUGGUGGCUGACCACCAUCAGCA CGGACCUGACGUUCUCCGUGAAGUCGAGCAGGGGGAGCUCCGAUCCCCAGGGCGUG ACCUGCGGCGCGGCCACCCUGAGCGCCGAGCGCGUCCGCGGGGACAAUAAGGAAUA CGAAUAUAGCGUGGAGUGCCAGGAGGACAGCGCCCUGCCCGCGGCCGAGGAGAGCC UCCCGAUCGAGGUGAUGGUGGAUGCCGUCCACAAGCUCAAAUACGAAAACUACACC AGCAGCUUCUUCAUUAGGGACAUCAUCAAGCCCGACCCCCCCAAAAACCUGCAGCU GAAGCCCCUGAAGAACAGCCGCCAGGUCGAGGUGUCAUGGGAGUACCCAGACACCU GGAGCACCCCCCACUCCUACUUCAGCCUGACCUUCUGCGUCCAGGUGCAGGGAAAG UCCAAACGGGAGAAGAAGGAUAGGGUCUUUACCGAUAAGACGUCGGCCACCGUCAU CUGCAGGAAGAACGCCAGCAUAAGCGUGCGGGCGCAGGAUCGGUACUACAGCUCGA GCUGGUCCGAAUGGGCCUCCGUGCCCGUAGCGGAGGGGUGGCGGGGGCAGCAGG AACCUGCCCGUGGCCACCCCGGACCCGGGCAUGUUUCCCUGCCUGCAUCACAGUCA GAACCUGCUGAGGGCCGUGAGCAACAUGCUCCAGAAGGCCCGCCAGACCCUGGAGU UUUACCCCUGCACCAGCGAAGAGAUCGAUCACGAAGACAUCACCAAAGACAAGACC UCCACCGUGGAGGCCUGUCUGCCCCUGGAGCUGACCAAGAACGAGAGCUGUCUGAA CAGCAGGGAGACCUCCUUCAUCACCAACGGCUCCUGCCUGGCAUCCCGGAAGACCA GCUUCAUGAUGGGCCCUGUGUCUGAGCUCUAUCUACGAGGACCUGAAGAUGUACCAG GUCGAGUUCAAGACCAUGAACGCCAAGCUGCUGAUGGACCCCAAGCGACAGAUAUU CCUGGACCAGAACAUGCUCGCCGUGAUCGAUGAACUGAUGCAAGCCCUGAACUUCA AUAGCGAGACCGUGCCCCAGAAAAGCAGCCUGGAGGAGCCCGACUUCUACAAGACC AAGAUCAAACUGUGCAUACUGCUGCACGCGUUCAGGAUCCGGGCCGUCACCAUCGA CCGGGUGAUGUCCUAUCUGAAUGCCAGC |
| 322 | hIL12AB_033 ORF | AUGUGCCACCAGCAGCUCGUGAUUAGCUGGUUUUCGCUGGUGUUCCUGGCCAGCCC UCUCGUGGCCAUCUGGGAGCUGAAAAAGACGUGUACGUGGUGGAGCUGGACUGGU ACCCGGACGCCCCCGGCGAGAUGGUGGUGCUGACGUGCGACACCCCGGAAGAGGAC GGCAUCACCUGGACCCUGGACCAGUCAUCCGAGGUCCUGGGCAGCGGCAAGACGCU CACCAUCCAGGUGAAGGAGUUCGGCGACGCCGGCCAGUACACAUGCCAUAAGGGCG |

SUMMARY OF SEQUENCES

| SEQ ID NO | Description | Sequence |
|---|---|---|
| | | GGGAGGUGCUGAGCCACAGCCUGCUCCUCCUGCACAAGAAGGAGGAUGGCAUCUGG UCUACAGACAUCCUGAAGGACCAGAAAGAGCCCAAGAACAAGACCUUCCUCCGGUG CGAGGCCAAGAACUACUCCGGGCGGUUUACUUGUUGGUGGCUGACCACCAUCAGCA CCGACCUCACCUUCAGCGUGAAGAGCUCCCGAGGGAGCUCCGACCCCCAGGGGGUC ACCUGCGGCGCCGCCACCCUGAGCGCCGAGCGGGUGAGGGGCGACAACAAGGAGUA UGAAUACAGCGUGGAAUGCCAAGAGGACAGCGCCUGUCCCGCGGCCGAGGAAAGCC UGCCCAUCGAGGUGAUGGUGGACGCCGUCCACAAACUCAAGUACGAGAACUACACC AGCAGUUUCUUCAUUCGCGACAUCAUCAAGCCGGACCCCCCCAAAAACCUGCAGCU CAAACCCCUGAAGAACAGCAGGCAGGUGGAGGUCAGCUGGGAGUACCCGGACACCU GGAGCACCCCCCAUAGCUACUUCAGCCUGACCUUCUGCGUGCAGGUGCAGGGCAAG AGCAAACGCGAGAAGAAGGACCGGGUGUUUACCGACAAGACCAGCGCCACGGUGAU CUGCCGAAAGAAUGCAAGCAUCUCCGUGAGGGCGCAGGACCGCUACUACUCUAGCA GCUGGAGCGAGUGGGCCAGCGUGCCCUGCAGCGGUGGCGGCGGAGGCGGCAGCCGU AACCUCCCGUGGCCACCCCCGACCCCGGCAUGUUCCCGUGUCUGCACCACUCCCA GAACCUGCUGAGGGCCGUCAGCAAUAUGCUGCAGAAGGCCCGGCAGACGCUGGAGU UCUACCCCUGCACCUCCGAGGAGAUCGACCAUGAGGACAUUACCAAGGACAAGACG AGCACUGUGGAGGCCUGCCUGCCCCUGGAGCUCACCAAAAACGAGAGCUGCCUGAA UAGCAGGGAGACGUCCUUCAUCACCAACGGCAGCUGUCUGGCCAGCAGGAAGACCA GCUUCAUGAUGGCCCUGUGCCUCUCCUCCAUAUAUGAGGAUCUGAAGAUGUACCAG GUGGAGUUCAAGACCAUGAACGCCAAGCUGCUGAUGGAUCCAAGAGGCAGAUCUU CCUGGACCAGAAUAUGCUGGCCGUGAUUGACGAGCUGAUGCAGGCCCUGAACUUUA AUAGCGAGACCGUCCCCCAGAAGAGCAGCCUGGAGGAGCCCGACUUCUAUAAGACC AAGAUCAAGCUGUGCAUACUGCUGCACGCGUUUAGGAUAAGGGCCGUCACCAUCGA CAGGGUGAUGAGCUACCUGAAUGCCAGC |
| 323 | hIL12AB_034 ORF | AUGUGCCACCAACAGCUGGUGAUCUCCUGGUUCAGCCUGGUGUUCCUCGCCAGCCC CCUGGUGGCCAUCUGGGAGCUGAAGAAAGACGUGUACGUGGUGGAGCUGGACUGGU AUCCCGACGCCCCCGGCGAGAUGGUCGUGCUGACCUGCGACACCCCCGAGGAGGAC GGCAUCACCUGGACCCUGGAUCAGUCCUCCGAGGUGCUGGGCAGCGGGAAGACCCU GACCAUCCAGGUGAAAGAGUUCGGAGAUGCCGGCCAGUAUACCUGUCACAAGGGGG GUGAGGUGCUGAGCCAUAGCCUCUUGCUUCUGCACAAGAAGGAGGACGGCAUCUGG UCCACCGACAUCCUCAAGGACCAAAAGGAGCCGAAGAAUAAAACGUUCCUGAGGUG CGAAGCCAAGAACUAUUCCGGACGGUUCACCUGCUGGUGGCUGACCACCAUCAGCA CCGACCUCACCUUCUCCGUAAAGUCAAGCAGGGGCAGCUCCGACCCCCAGGGCGUG ACCUGCGGAGCCGCCACCCUGAGCGCAGAGAGGGUGAGGGGCGACAACAAGGAGUA CGAAUACUCCGUCGAGUGCCAGGAGGACAGCGCCUGCCCCGCCGCCGAGGAAAGUC UGCCCAUCGAGGUGAUGGUGGACGCCGUGCACAAGCUCAAAUACGAGAACUACACC AGCAGCUUCUUCAUCCGGGAUAUCAUCAAGCCCGACCCUCCAAAGAAUCUGCAGCU GAAACCCCUUAAGAACAGCAGGCAGGUGGAGGUCAGCUGGGAGUACCCCGACACCU GGAGCACGCCCCACUCCUACUUUAGCCUGACCUUUUGCGUGCAGGUGCAGGGGAAA AGCAAGCGGGAGAAGAAGGACAGGGUGUUCACCGAUAAGACCUCCGCUACCGUGAU CUGCAGGAAGAACGCCUCAAUCAGCGUGAGGGCCCAGGAUCGGUACUACUCCAGCU CCUGGAGCGAGUGGGCAGCGUGCCCUGCUCUGGCGGUGGCGGCGGGGGCAGCCGG AACCUGCCGGUGGCCACUCCCGACCCGGGCAUGUUCCCGUGCCUCCACCAUUCCCA GAACCUGCUGCGGGCCGUGUCCAAUAUGCUCCAGAAGGCAAGGCAGACCCUGGAGU UCUACCCCUGCACCAGCGAGGAGAUCGAUCACGAGGACAUCACCAAAGACAAAACC AGCACGGUCGAGGCCUGCCUGCCCCUGGAACUCACCAAGAACGAAAGCUGUCUCAA CAGCCGCGAGACCAGCUUCAUAACCAACGGUUCCUGUCUGGCCUCCCGCAAGACCA GCUUUAUGAUGGCCCUCUGUCUGAGCUCCAUCUAUGAAGACCUGAAAAUGUACCAG UGGGAGUUCAAAACCAUGAACGCCAAGCUUCUGAUGGACCCCAAGAGGCAGAUCUU CCUGGAUCAGAACAUGCUGGCCGUGAUCGACGAGCUGAUGCAGGCCCUGAACUUUA ACUCCGAGACCGUGCCCCAGAAAAGCAGCCUGGAAGAGCCCGAUUUCUACAAAACG AAGAUCAAGCUGUGCAUCCUGCUGCACGCCUUCCGGAUCCGUGCGGUGACCAUCGA UAGGGUGAUGAGCUACCUGAACGCCAGC |
| 324 | hIL12AB_035 ORF | AUGUGCCACCAACAGCUGGUAAUCAGCUGGUUCAGCCUGGUUUUCCUCGCGUCGCC CCUGGUGGCCAUCUGGGAGUUAAAGAAGGACGUGUACGUGGUGGAGCUGGAUUGGU ACCCCGACGCCCCGGGCGAGAUGGUCGUGCUCACCUGCGAUACCCCCGAGGAGGAC GGGAUCACCUGGACCCUGGACCAAUCCAGCGAGGUGCUGGGCAGCGGCAAGACCCU GACCAUACAGGUGAAGGAAUUUGGGGACGCCGGCCAGUACACCUGCCACAAGGGCG GGAAGUGCUGUCCCACUCCCUCCUGCUGCUGCAUAAGAAGGAGGACGGCAUCUGG AGCACCGACAUCCUGAAGGACCAAAAGGAGCCCAAGAACAAGACCUUCCUGAGGUG CGAGGCCAAAAACUAUUCCGGCCGCUUUACCUGUUGGUGGCUGACCACCAUCUCCA CCGAUCUGACCUUCAGCGUGAAGUCGUCUAGGGGCUCCUCCGACCCCCAGGGCGUA ACCUGCGGCGCCGCGACCCUGAGCGCCGAGGGGUGCGGGGCGAUAACAAAGAGUA CGAGUACUCGGUGGAGUGCCAGGAGGACAGCGCCUGUCCGGCGGCCGAGGAGAGCC UGCCCAUCGAGGUGAUGGUGGACGCCGUCCACAAGCUGAAGUACGAGAACUACACC AGUUCGUUCUUCAUCAGGGACAUCAUCAAGCCGGACCCCCCCAAGAACCUCCAGCU GAAGCCCCUGAAGAACAGCAGGCAGGUGGAAGUGUCCUGGGAGUAUCCCGACACCU GGAGCACCCCCACAGCUACUUCAGCCUGACCUUUUGCGUGCAGGUGCAGGGCAAA AGCAAGAGGGAAAGAAGGACCGGGUGUUCACCGAUAAGACGAGCGCCACCGUUAU CUGCAGGAAGAACGCCUCCAUAAGCGUGAGGGCGCAGGACCGUUACUACAGCAGCA GCUGGAGUGAGUGGGCAAGCGUGCCCUGUAGCGGCGGGGGCGGGGGCGGGUCCCGC |

| SEQ ID NO | Description | Sequence |
|---|---|---|
| | | AACCUCCCCGUCGCCACCCCCGACCCAGGCAUGUUUCCGUGCCUGCACCACAGCCA<br>GAACCUGCUGCGGGCCGUUAGCAACAUGCUGCAGAAGGCCAGGCAGACCCUCGAGU<br>UCUAUCCCUGCACAUCUGAGGAGAUCGACCACGAAGACAUCACUAAGGAUAAGACC<br>UCCACCGUGGAGGCCUGUCUGCCCCUCGAGCUGACCAAGAAUGAAUCCUGCCUGAA<br>CAGCCGAGAGACCAGCUUUAUCACCAACGGCUCCUGCCUGGCCAGCAGGAAGACCU<br>CCUUCAUGAUGGCCCUGUGCCUCUCCAGCAUCUACGAGGAUCUGAAGAUGUACCAG<br>GUAGAGUUCAAGACGAUGAACGCCAAGCUCCUGAUGGACCCCAAGAGGCAGAUAUU<br>CCUGGACCAGAACAUGCUGGCGGUGAUCGACGAGCUGAUGCAGGCCCUGAAUUUCA<br>ACAGCGAGACGGUGCCACAGAAGUCCAGCCUGGAGGAGCCAGACUUCUACAAGACC<br>AAGAUCAAACUGUGCAUCCUCCUGCACGCGUUCAGGAUCCGCGCCGUCACCAUAGA<br>CAGGGUGAUGAGUUAUCUGAACGCCAGC |
| 325 | hIL12AB_036 ORF | AUGUGCCAUCAGCAGCUGGUAAUCAGCUGGUUUAGCCUGGUGUUCCUGGCCAGCCC<br>ACUGGUGGCCAUCUGGGAGCUGAAGAAGGACGUGUACGUGGUGGAACUGGACUGGU<br>ACCCCGACGCCCCUGGCGAGAUGGUGGUACUGACCUGUGACACCCCGGAGGAAGAC<br>GGUAUCACCUGGACCCUGGAUCAGAGCUCCGAGGUGCUGGGCUCCGGCAAGACACU<br>GACCAUCCAAGUUAAGGAAUUUGGGGACGCCGGCCAGUACACCUGCCACAAGGGGG<br>GCGAGGUGCUGUCCCACUCCCUGCUGCUUCUGCAUAAGAAGGAGGAUGGCAUCUGG<br>UCCACCGACAUACUGAAGGACCAGAAGGAGCCCAAGAAUAAGACCUUCCUGAGAUG<br>CGAGGCCAAGAACUACUCGGGAAGGUUCACCUGCUGGUGGCUGACCACCAUCAGCA<br>CCGACCUGACCUUCUCCGUGAAGAGCUCCCGGGGCAGCUCCGACCCCCAGGGCGUA<br>ACCUGUGGGGCCGCUACCCUGUCCGCCGAGAGGGUCCGGGGCGACAACAAGGAAUA<br>CGAGUACAGCGUGGAGUGCCAGGAGGACUCCGCCUGCCCCGCCGCCGAGGAGUCGC<br>UGCCCAUAGAGGUGAUGGUGGACGCCGUGCACAAGCUCAAGUACGAGAAUUACACC<br>AGCAGCUUCUUUAUCAGGGACAUAAUUAAGCCGGACCCCCCAAAGAAUCUGCAGCU<br>GAAGCCCCUGAAGAAUAGCCGGCAGGUGGAAGUGUCCUGGGAGUACCCCGACACCU<br>GGAGCACCCCCACUCCUAUUUCUCACUGACAUUCUGCGUGCAGGUGCAAGGGAAA<br>AGCAAGAGGGAGAAGAAGGAUAGGGUGUUCACCGACAAGACAAGCGCCACCGUGAU<br>CUGCCGAAAAAAUGCCAGCAUCAGCGUGAGGGCCCAGGAUGCGUAUUACAGCAGCU<br>CCUGGAGCGAGUGGGCCAGCGUGCCCUGUUCCGGCGGGGAGGGGCGGCUCCCGG<br>AACCUGCCGGUGGCCACCCCCGACCCUGGCAUGUUCCCCUGCCUGCAUCACAGCCA<br>GAACCUGCUCCGGGCCGUGUCGAACAUGCUGCAGAAGGCCCGGCAGACCCUCGAGU<br>UUUACCCCUGCACCAGCGAAGAGAUCGACCACGAAGACAUAACCAAGGACAAGACC<br>AGCACGGUGGAGGCCUGCCUGCCCCUGGAGCUUACCAAAAACGAGUCCUGCCUGAA<br>CAGCCGGGAAACCAGCUUCAUAACGAACGGGAGCUGCCUGGCCUCCAGGAAGACCA<br>GCUUCAUGAUGGCGCUGUGUCUGUCCAGCAUAUACGAGGAUCUGAAGAUGUAUCAG<br>GUGGAAUUCAAAACUAUGAAUGCCAAGCUCCUGAUGGACCCCAAGAGGCAGAUCUU<br>CCUGGACCAGAACAUGCUAGCCGUGAUCGACGAGCUGAUGCAGGCCCUCAACUUCA<br>ACUCGGAGACGGUGCCCCAGAAGUCCAGCCUCGAGGAGCCCGACUUCUACAAGACC<br>AAGAUCAAGCUGUGCAUACUGCUGCAUGCCUUCAGGAUAAGGGCGGUGACUAUCGA<br>CAGGGUCAUGUCCUACCUGAACGCCAGC |
| 326 | hIL12AB_037 ORF | AUGUGCCACCAACAACUGGUGAUCAGCUGGUUCUCCCUGGUGUUCCUGGCCAGCCC<br>CCUGGUGGCCAUCUGGGAGCUCAAAAAAGACGUGUACGUGGUGGACCUGCAUUGGU<br>ACCCAGACGCGCCGGGGGAAAUGGUGGUGCUGACCUGCGACACCCCAGAGGAGGAU<br>GGCAUCACGUGGACGCUGGAUCAGUCCAGCGAGGUGCUGGGGAGCGGCAAGACGCU<br>CACCAUCCAGGUGAAGGAAUUUGGCGACGCGGGCCAGUAUACCUGUCAAAGGGCG<br>GCGAGGUGCUGAGCCACUCCCUGCUGCUGCUGCACAAGAAGGAGGAUGGGAUCUGG<br>UCAACCGAUAUCCUGAAAGACCAGAAGGAGCCCAAGAACAAGACCUUCCUGCGCUG<br>CGAGGCCAAGAACUAUAGCGGCAGGUUCACCUGCUGGUGGCUGACCACCAUCAGCA<br>CCGACCUGACCUUCAGCGUGAAAUCCUCCAGGGGCAGCAGCGACCCCCAGGGCGUG<br>ACCUGCGGUGCCGCCACGCUCUCCGCCGAGCGAGUGAGGGGUGACAACAAGGAGUA<br>CGAGUACAGCGUGGAAUGUCAGGAGGACAGCGCCUGUCCCGCCGCCGAGGAGUCGC<br>UGCCCAUCGAGGUGAUGGUCGACGCGGUGCACAAGCUCAAAUACGAGAAUUACACC<br>AGCAGCUUCUUCAUCAGGGACAUCAUCAAGCCCGACCCCCCAAGAACCUGCAGCU<br>GAAGCCCUUGAAGAACAGCAGGCAGGUGGAGGUGAGCUGGGAGUACCCGGACACCU<br>GGAGCACCCCCACUCCUACUUCAGCCUGACGUUCUGUGUGCAGGUGCAGGGGAAG<br>UCCAAGAGGGAGAAGAAGGACCGGGUGUUCACCGACAAGACCAGCGCCACCGUGAU<br>AUGCCGCAAGAACGCGUCCAUCAGCGUUCGCGCCCAGGACCGCUACUACAGCAGCU<br>CCUGGUCCGAAUGGGCCAGCGUGCCCUGCAGCGGUGAGGGGCGGGGCUCCAGG<br>AAUCUGCCGGUGGCCACCCCCGACCCCGGGAUGUUCCCGUGUCUGCAUCACUCCCA<br>GAACCUGCUGCGGGCCGUGAGCAAUAUGCUGCAGAAGGCCAGGCAGACGCUCGAGU<br>UCUACCCCUGCACCUCCGAAGAGAUCGACCAUGAGGACAUCACCAAGGACAAGACC<br>AGCACCGUGGAGGCCUGCCUCCCCCUGGAGCUGACCAAAAACGAGAGCUGCCUGAA<br>CUCCAGGGAGACCAGCUUUAUAACCAACGGCAGCUGCCUCGCCUCCAGGAAGACCU<br>CGUUUAUGAUGGCCCUCUGCCUGUCCAGCAUCUACGAGGACCUGAAGAUGUACCAG<br>GUGGAGUUCAAGACCAUGAACGCGAAGUUGCUCAUGGACCCCAAGAGGCAGAUCUU<br>CCUGGACCAGAACAUGCUCGCGGUGAUCGACGAGCUGAUGCAAGCCCUGAACUUCA<br>ACAGCGAGACCGUGCCCCAGAAGAGCAGCCUGGAAGAGCCCGACUUCUACAAGACC<br>AAGAUCAAGCUGUGCAUCCUGCUGCACGCCUUCCGGAUCCGGGCCGUGACCAUCGA<br>CAGGGUGAUGAGCUACCUCAACGCCUCC |

-continued

SUMMARY OF SEQUENCES

| SEQ ID NO | Description | Sequence |
|---|---|---|
| 327 | hIL12AB_038 ORF | AUGUGCCACCAGCAGCUCGUGAUCAGCUGGUUCUCCCUCGUCUUCCUGGCCUCCCC GCUGGUGGCCAUCUGGGAGCUGAAGAAGGACGUGUACGUGGUGGAGCUGGACUGGU AUCCCGACGCCCCCGGCGAGAUGGUGGUGCUGACGUGCGACACACCAGAAGAGGAC GGGAUCACAUGGACCCUGGAUCAGUCGUCCGAGGUGCUGGGGAGCGGCAAGACCCU CACCAUCCAAGUGAAGGAGUUCGGGGACGCCGGCCAGUACACCUGCCACAAGGGCG GGGAGGUGCUCUCCCAUAGCCUGCUCCUCCUGCACAAAAAGGAGGAUGGCAUCUGG AGCACCGACAUCCUGAAGGACCAGAAGGAGCCCAAGAACAAGACAUUUCUCAGGUG UGAGGCCAAGAACUAUUCGGGCAGGUUUACCUGUUGGUGGCUCACCACCAUCUCUA CCGACCUGACGUUCUCCGUCAAGUCAAGCAGGGGGAGCUCGGACCCCCAGGGGGUG ACAUGUGGGGCCGCCACCCUGAGCGCGGAGCGUGUCCGCGGCGACAACAAGGAGUA CGAGUAUUCCGUGGAGUGCCAGGAGGACAGCGCCUGCCCCGCCGCCGAGGAGUCCC UGCCCAUAGAGGUGAUGGUGGACGCCGUCCACAAGUUGAAGUACGAAAAUUAUACC UCCUCGUUCUUCAUUAGGGACAUCAUCAAGCCUGACCCCCCGAAGAACCUACAACU CAAGCCCCUCAAGAACUCCCGCCAGGUGGAGGUGUCCUGGGAGUACCCCGACACCU GGUCCACCCCGCACAGCUACUUCAGCCUGACCUUCUGCGUGCAGGUCCAGGGGAAG AGCAAGCGUGAAAAGAAAGACAGGGUGUUCACCGACAAGACGAGCGCCACCGUGAU CUGCAGGAAAAACGCCUCCAUCUCCGUGCGCGCCCAGGACAGGUACUACAGUAGCU CCUGGAGCGAAUGGGCCAGCGUGCCGUGCAGCGGCGGGGAGGAGGCGGCAGUCGC AACCUGCCCGUGGCCACCCCCGACCCCGGCAUGUUCCCAUGCCUGCACCACAGCCA GAACCUGCUGAGGGCAGUCAGCAAUAUGCUGCAGAAGGCCAGGCAGACCCUGGAGU UUUAUCCCUGCACCAGCGAGGAGAUCGACCACGAGGACAUCACCAAGGACAAGACC UCCACCGUCGAGGCCUGCCUGCCACUGGAGCUGACCAAAAACGAGAGCUGCCUGAA CUCCAGGGAGACCUCCUUCAUCACCAACGGGAGCUGCCUGGCCAGCCGGAAGACCA GCUUCAUGAUGGCGCUGUGCCUCAGCAGCAUCUACGAGGAUCUCAAGAUGUACCAG GUGGAGUUCAAGACCAUGAACGCGAAGCUGCUGAUGGACCCCAAGCGGCAGAUCUU CCUGGACCAGAACAUGCUGGCCGUGAUUGACGAGCUCAUGCAGGCCCUGAACUUCA AUAGCGAGACCGUCCCCAAAAGAGCAGCCUGGAGGAACCCGACUUCUACAAAACG AAGAUCAAGCUCUGCAUCCUGCUGCACGCCUUCCGGAUCCGGGCCGUGACCAUCGA UCGUGUGAUGAGCUACCUGAACGCCUCG |
| 328 | hIL12AB_039 ORF | AUGUGCCACCAGCAGCUCGUCAUCUCCUGGUUUAGCCUGGUGUUUCUGGCCUCCCC CCUUGGUCGCCAUCUGGGAGCUGAAGAAAGACGUGUACGUGGUGGAGCUGGACUGGU ACCCGGACGCUCCCGGGGAGAUGGUGGUGCUGACCUGCGACACCCCCGAGGAGGAC GGCAUCACCUGGACCCUGGACCAGAGCUCCGAGGUGCUGGGGAGCGGCAAGACCCU GACCAUUCAGGUGAAAGAGUUCGGCGACGCCGGCCAAUAUACCUGCCACAAGGGGG GGGAGGUCCUGUCGCAUUCCCUGCUGCUGCUUCACAAAAAGGAGGAUGGCAUCUGG AGCACCGACAUCCUGAAGGACCAGAAAGAACCCAAGAACAAGACGUUCCUGCGCUG CGAGGCCAAGAACUACAGCGGCCGGUUCACCUGUUGGUGGCUGACCACCAUCUCCA CCGACCUGACUUUCUCGGUGAAGAGCAGCCGCGGGAGCAGCGACCCCCAGGGAGUG ACCUGCGGCGCCGCCACCCUGAGCGCCGAAAGGGUGAGGGGCGACAAUAAAGAGUA CGAGUAUUCCGUGGAGUGCCAGGAGGACAGCGCCUGUCCCGCCGCCGAGGAGUCCC UGCCUAUCGAGGUGAUGGUCGACGCGGUGCACAAGCUCAAGUACGAAAACUACACC AGCAGCUUUUUCAUCAGGGAUAUCAUCAAACCAGACCCCCCCAAGAACCUGCAGCU GAAGCCCCUGAAAAACAGCAGGCAGGUGGAAGUGAGCUGGGAAUACCCCGAUACCU GGUCCACCCCCCACAGCUACUUCAGCCUGACCUUCUGCGUGCAGGUGCAGGGGAAG UCCAAGCGGGAGAAGAAAGAUCGGGUGUUCACGGACAAGACCAGCGCCACCGUGAU UUGCAGGAAAAACGCCAGCAUCUCCGUGAGGGCUCAGGACAGGUACUACAGCUCCA GCUGGAGCGAGUGGGCCUCCGUGCCUUGCAGCGGGGAGGAGGCGGCGGCAGCAGG AAUCUGCCCGUCGCAACCCCCGACCCCGGCAUGUUCCCCUGCCUGCACCACAGCCA GAAUCUGCUGCGAGCCGUGAGCAACAUGCUCCAGAAGGCCCGGCAGACGCUGGAGU UCUACCCCUGCACCUCCGAGGAGAUCGACCACGAGGACAUCACCAAGGAUAAGACG AGCACCGUCGAGGCCUGUCUCCCCUGGAGCUCACCAAGAACGAGUCCUGCCUGAA UAGCAGGGAGACGUCCUUCAUAACCAACGGCAGCUGUCUGGCCGUCCAGGAAGACCA GCUUCAUGAUGGCCCUCUGCCUGAGCUCCAUCUACGAGGACCUCAAGAUGUACCAG GUCGAGUUCAAGACCAUGAACGCAAAACUGCUCAUGGAUCCAAAGAGGCAGAUCUU UCUGGACCAGAACAUGCUGGCCGUGAUCGAUGAACUCAUGCAGGCCCUGAAUUUCA AUUCCGAGACCGUGCCCCAGAAGAGCUCCUGGAGGAACCCGACUUCUACAAAACA AAGAUCAAGCUGUGUAUCCUCCUGCACGCCUUCCGGAUCAGGGCCGUCACCAUUGA CCGGGUGAUGUCCUACCUGAACGCCAGC |
| 329 | hIL12AB_040 ORF | AUGUGCCAUCAGCAGCUGGUGAUCAGCUGGUUCAGCCUCGUGUUCCUCGCCAGCCC CCUCGUGGCCAUCUGGGAGCUGAAAAAGGACGUGUACGUGGUGGAGCUGGACUGGU AUCCCGACGCCCCGGGCGAGAUGGUGGUGCUGACCUGCGACACCCCCGAGGAGGAC GGCAUUACCUGGACACUGGACCAGAGCAGCGAGGUCCUGGGCAGCGGGAAGACCCU GACAAUUCAGGUGAAGGAGUUCGGCGACGCCGGACAGUACACGUGCCACAAGGGGG GGGAGGUGCUGUCCCACAGCCUCCUCCUGCUGCACAAGAAGGAGGAUGGCAUCUGG AGCACCGACAUCCUGAAGGAUCAGAAGGAGCCCAAGAACAAGACCUUUCUGAGAUG CGAGGCCAAGAAUUACAGCGGCCGUUUCACCUGCUGGUGGCUCACCACCAUCAGCA CCGACCUGACCUUCAGCGUGAAAUCCUCCAGGGGCUCCUCCGACCCGCAGGGAGUG ACCUGCGGCGCCGCCACACUGAGCGCCGAGCGGGUCAGAGGGGACAACAAGGAGUA CGAGUACAGCGUUGAGUGCCAGGAGGACAGCGCCUGUCCCGCGCCGAGGAAUCCC UGCCCAUCGAGGUGAUGGUGGACGCAGUGCACAAGCUGAAGUACGAGAACUAUACC UCGAGCUUCUUCAUCCGGGAUAUCAUUAAGCCCGAUCCCCCGAAGAACCUGCAGCU

| SEQ ID NO | Description | Sequence |
|---|---|---|
| | | CAAACCCCUGAAGAACAGCAGGCAGGUGGAGGUCUCCUGGGAGUACCCCGACACAU
GGUCCACCCCCAUUCCUAUUUCUCCCUGACCUUUUGCGUGCAGGUGCAGGGCAAG
AGCAAGAGGGAGAAAAAGGACAGGGUGUUCACCGACAAGACCUCCGCCACCGUGAU
CUGCCGUAAGAACGCUAGCAUCAGCGUCAGGGCCCAGGACAGGUACUAUAGCAGCU
CCUGGUCCGAGUGGGCCAGCGUCCCGUGCAGCGGCGGGGGCGGUGGAGGCUCCCGG
AACCUCCCGUGGCCACCCCGGACCCCGGGAUGUUUCCCUGCCUGCAUCACAGCCA
GAACCUGCUGAGGGCCGUGUCCAACAUGCUGCAGAAGGCCAGGCAGACACUCGAGU
UUUACCCCUGCACCAGCGAGGAGAUCGACCACGAAGACAUCACCAAGGACAAGACC
UCCACCGUGGAGGCAUGCCUGCCCCUGGAGCUGACCAAAAACGAAAGCUGUCUGAA
CUCCAGGGAGACCUCCUUUAUCACGAACGGCUCAUGCCUGGCCUCCAGAAAGACCA
GCUUCAUGAUGGCCCUGUGCCUGAGCUCCAUCUACGAGGACUUGAAAAUGUACCAG
GUCGAGUUCAAGACCAUGAACGCCAAGCUGCUCAUGGACCCCAAAAGGCAGAUCUU
UCUGGACCAGAAUAUGCUGGCCGUGAUCGACGAGCUCAUGCAAGCCCUGAAUUUCA
ACAGCGAGACCGUGCCCCAGAAGUCCUCCCUGGAGGAGCCCGACUUCUACAAGACC
AAGAUCAAGCUGUGCAUACUCCUGCACGCGUUUAGGAUCAGGGCGGUGACCAUCGA
UAGGGUGAUGAGCUACCUGAAUGCCUCC |
| 330 | Wild Type IL12B signal peptide Nucleic acids | AUGUGUCACCAGCAGUUGGUCAUCUCUUGGUUUUCCCUGGUUUUUCUGGCAUCUCC
CCUCGUGGCC |
| 331 | Syn 5 promoter | AUUGGGCACCCGUAAGGG |
| 332 | hIL12AB_001 (5'UTR ORF 3'UTR) | UCAAGCUUUUGGACCCUCGUACAGAAGCUAAUACGACUCACUAUAGGGAAAUAAGA
GAGAAAAGAAGAGUAAGAAGAAAUAUAAGAGCCACCAUGUGUCACCAGCAGCUGGU
CAUUAGCUGGUUUAGCCUUGUGUUCCUGGCCUCCCCCCUUGUCGCUAUUUGGGAGC
UCAAGAAGGACGUGUACGUGGUGGAGUUGGAUUGGUACCCAGACGCGCCCGGAGAG
AUGGUAGUUCUGACCUGUGAUACCCCAGAGGAGGACGGCAUCACCUGGACGCUGGA
CCAAAGCAGCGAGGUUUUGGGCUCAGGGAAAACGCUGACCAUCCAGGUGAAGGAAU
UCGGCGACGCCGGGCAGUACACCUGCCAUAAGGGAGGAGAGGUGCUGAGCCAUUCC
CUUCUUCUGCUGCACAAGAAAGAGGACGGCAUCUGGUCUACCGACAUCCUGAAAGA
CCAGAAGGAGCCCAAGAACAAAACCUUCCUGAGGUGCGAGGCCAAGAACUACUCCG
GCAGGUUCACUUGUUGGUGGCUGACCACCAUCAGUACAGACCUGACUUUUAGUGUA
AAAAGCUCCAGAGGCUCGUCCGAUCCCCAAGGGGUGACCUGCGGCGCAGCCACUCU
GAGCGCUGAGCGCGUGCGCGGUGACAAUAAAGAGUACGAGUACAGCGUUGAGUGUC
AAGAAGAUAGCGCUUGCCCCUGCCGCCGAGGAGAGCCUGCCUAUCGAGGUGAUGGUU
GACGCAGUGCACAAGCUUAAGUACGAGAAUUACACCAGCUCAUUCUUCAUUAGAGA
UAUAAUCAAGCCUGACCCACCCAAGAACCUGCAGCUGAAGCCACUGAAAAACUCAC
GGCAGGUCGAAGUGAGCUGGGAGUACCCCGACACCUGGAGCACUCCUCAUUCCUAU
UUCUCUCUUACAUUCUGCGUCCAGGUGCAGGGCAAGAGCAAGCGGGAAAAGAAGGA
UCGAGUCUUCACCGACAAAACAAGCGCGACCGUGAUUUGCAGGAAGAACGCCAGCA
UCUCCGUCAGAGCCCAGGAUGAUACUAUAGUAGCAGCUGGAGCGAGUGGGCAAGC
GUGCCCUGUUCCGGCGGCGGGGGCGGGGGCAGCGAAACUUGCCUGUCGCUACCCC
GGACCCUGGAAUGUUUCCGUGUCUGCACCACAGCCAGAACCUGCUGAGAGCCGUGU
CGAAUAUGCUCCAGAAGGCCCGGCAGACCCUUGAGUUCUACCCCUGUACCAGCGAA
GAGAUCGAUCAUGAAGAUAUCACGAAAGAUAAAACAUCCACCGUCGAGGCUUGUCU
CCCGCUGGAGCUGACCAAGAACGAGAGCUGUCUGAAUAGCCGGGAGACGUCUUUCA
UCACGAAUGGUAGCUGUCUGGCCAGCAGGAAAACUUCCUUCAUGAUGGCUCUCUGC
CUGAGCUCUAUCUAUGAAGAUCUGAAGAUGUAUCAGGUGGAGUUUAAAACAAUGAA
CGCCAAACUCCUGAUGGACCCAAAAAGGCAAAUCUUUCUGGACCAGAAUAUGCUGG
CCGUGAUAGACGAGCUGAUGCAGGCACUGAACUUCAACAGCGAGACGGUGCCACAG
AAAUCCAGCCUGGAGGAGCCUGACUUUUACAAAACUAAGAUCAAGCUGUGUAUCCU
GCUGCACGCCUUUAGAAUCCGUCGUGACUAUCGACAGGGUGAUGUCAUACCUCA
ACGCUUCAUGAUAAUAGGCUGGAGCCUCGGUGGCCAUGCUUCUUGCCCCUUGGGCC
UCCCCCCAGCCCCUCCUCCCCUUCCUGCACCCGUACCCCCCAAACACCAUUGUCAC
ACUCCAGUGGUCUUUGAAUAAAGUCUGAGUGGGCGGC |
| 333 | hIL12AB_002 (5'UTR ORF 3'UTR) | UCAAGCUUUUGGACCCUCGUACAGAAGCUAAUACGACUCACUAUAGGGAAAUAAGA
GAGAAAAGAAGAGUAAGAAGAAAUAUAAGAGCCACCAUGUGCCACCAGCAGCUGGU
GAUCAGCUGGUUCAGCCUGGUGUUCCUGGCCAGCCCCCUGGUGGCCAUCUGGGAGC
UGAAGAAGGACGUGUACGUGGUGGAGUUGGAUUGGUACCCCGACGCCCCCGGCGAG
AUGGUGGUGCUGACCUGCGACACCCCCGAGGAGGACGGCAUCACCUGGACCCUGGA
CCAGAGCAGCGAGGUGCUGGGCAGCGGCAAGACCCUGACCAUCCAGGUGAAGGAGU
UCGGCGACGCCGGCCAGUACACCUGCCACAAGGGCGGCGAGGUGCUGAGCCACAGC
CUGCUGCUGCUGCACAAGAAGGAGGACGGCAUCUGGAGCACCGACAUCCUGAAGGA
CCAGAAGGAGCCCAAGAACAAGACCUUCCUGAGAUGCGAGGCCAAGAACUACAGCG
GCAGAUUCACCUGCUGGUGGCUGACCACCAUCAGCACCGACCUGACCUUCAGCGUG
AAGAGCAGCAGAGGCAGCAGCGACCCCCAGGGCGUGACCUGCGGCGCCGCCACCCU
GAGCGCCGAGAGAGUGAGAGGCGACAACAAGGAGUACGAGUACAGCGUGGAGUGCC
AGGAAGAUAGCGCCUGCCCCGCCGCCGAGGAGAGCCUGCCCAUCGAGGUGAUGGUG
GACGCCGUGCACAAGCUGAAGUACGAGAACUACACCAGCAGCUUCUUCAUCAGAGA |

SUMMARY OF SEQUENCES

| SEQ ID NO | Description | Sequence |
|---|---|---|
| | | UAUCAUCAAGCCCGACCCCCCCAAGAACCUGCAGCUGAAGCCCCUGAAGAACAGCC GGCAGGUGGAGGUGAGCUGGGAGUACCCCGACACCUGGAGCACCCCCACAGCUAC UUCAGCCUGACCUUCUGCGUGCAGGUGCAGGGCAAGAGCAAGAGAGAAGAAAGA UAGAGUGUUCACCGACAAGACCAGCGCCACCGUGAUCUGCAGAAAGAACGCCAGCA UCAGCGUGAGAGCCCAAGAUAGAUACUACAGCAGCAGCUGGAGCGAGUGGGCCAGC GUGCCCUGCAGCGGCGGCGGCGGCGGCAGCAGAAACCUGCCCGUGGCCACCCC CGACCCCGGCAUGUUCCCCUGCCUGCACCACAGCCAGAACCUGCUGAGAGCCGUGA GCAACAUGCUGCAGAAGGCCCGGCAGACCCUGGAGUUCUACCCCUGCACCAGCGAG GAGAUCGACCACGAAGAUAUCACCAAAGAUAAGACCAGCACCGUGGAGGCCUGCCU GCCCCUGGAGCUGACCAAGAACGAGAGCUGCCUGAACAGCAGAGAGACCAGCUUCA UCACCAACGGCAGCUGCCUGGCCAGCAGAAAGACCAGCUUCAUGAUGGCCCUGUGC CUGAGCAGCAUCUACGAGGACCUGAAGAUGUACCAGGUGGAGUUCAAGACCAUGAA CGCCAAGCUGCUGAUGGACCCCAAGCGGCAGAUCUUCCUGGACCAGAACAUGCUGG CCGUGAUCGACGAGCUGAUGCAGGCCCUGAACUUCAACAGCGAGACCGUGCCCCAG AAGAGCAGCCUGGAGGAGCCCGACUUCUACAAGACCAAGAUCAAGCUGUGCAUCCU GCUGCACGCCUUCAGAAUCAGAGCCGUGACCAUCGACAGAGUGAUGAGCUACCUGA ACGCCAGCUGAUAAUAGGCUGGAGCCUCGGUGGCCAUGCUUCUUGCCCCUUGGGCC UCCCCCCAGCCCCUCCUCCCCUUCCUGCACCCGUACCCCCCAAACACCAUUGUCAC ACUCCAGUGGUCUUUGAAUAAAGUCUGAGUGGGCGGC |
| 334 | hIL12AB_003 (5'UTR ORF 3'UTR) | UCAAGCUUUUGGACCCUCGUACAGAAGCUAAUACGACUCACUAUAGGGAAAUAAGA GAGAAAAGAAGAGUAAGAAGAAAUAUAAGAGCCACCAUGUGUCACCAGCAGUUGGU CAUCUCUUGGUUUUCCUGGUUUUUCUGGCAUCUCCCCUCGUGGCCAUCUGGGAAC UGAAGAAAGACGUUUACGUUGUAGAAUUGGAUUGGUAUCCGGACGCUCCUGGAGAA AUGGUGGUCCUCACCUGUGACACCCCUGAAGAAGACGGAAUCACCUGGACCUUGGA CCAGAGCAGUGAGGUCUUAGGCUCUGGCAAAACCCUGACCAUCCAAGUCAAAGAGU UUGGAGAUGCUGGCCAGUACACCUGUCACAAAGGAGGCGAGGUUCUAAGCCAUUCG CUCCUGCUGCUUCACAAAAAGGAAGAUGGAAUUUGGUCCACUGAUAUUUUAAAGGA CCAGAAAGAACCCAAAAAUAAGACCUUUCUAAGAUGCGAGGCCAAGAAUUAUUCUG GACGUUUCACCUGCUGGUGGCUGACGACAAUCAGUACUGAUUUGACAUUCAGUGUC AAAAGCAGCAGAGGCUCUUCUGACCCCCAAGGGGUGACGUGCGGAGCUGCUACACU CUCUGCAGAGAGAGUCAGAGGUGACAACAAGGAGUAUGAGUACUCUCAGUGGAGUGCC AGGAAGAUAGUGCCUGCCCAGCUGCUGAGGAGAGUCUGCCCAUUGAGGUCAUGGUG GAUGCCGUUCACAAGCUCAAGUAUGAAAACUACACCAGCAGCUUCUUCAUCAGAGA UAUCAUCAAACCUGACCCACCCAAGAACUUGCAGCUGAAGCAUUAAAGGAAUUCUC GGCAGGUGGAGGUCAGCUGGGAGUACCCUGACACCUGGAGUACUCCACAUUCCUAC UUCUCCCUGACAUUCUGCGUUCAGGUCCAGGGCAAGAGCAAGAGAGAAAAGAAAGA UAGAGUCUUCACAGAUAAGACCUCAGCCACGGUCAUCUGCCGCAAAAAUGCCAGCA UUAGCGUGCGGGCCCAGGACCGCUACUAUAGCUCAUCUUGGAGCGAAUGGGCAUCU GUGCCCUGCAGUGGCGGAGGGGGCGGAGGGAGCAGAAACCUCCCCGUGGCCACUCC AGACCCAGGAAUGUUCCCAUGCCUUCACCACUCCCAAAACCUGCUGAGGGCCGUCA GCAACAUGCUCCAGAAGGCCCGGCAAACUUUAGAAUUUUACCCUUGCACUUCUGAA GAGAUUGAUCAUGAAGAUAUCACAAAAGAUAAAACCAGCACAGUGGAGGCCUGUUU ACCAUUGGAAUUAACCAAGAAUGAGAGUUGCCUAAAUUCCAGAGAGACCUCUUUCA UAACUAAUGGGAGUUGCCUGGCCUCCAGAAAGACCUCUUUUAUGAUGGCCCUGUGC CUUAGUAGUAUUUAUGAAGAUUUGAAGAUGUACCAGGUGGAGUUCAAGACCAUGAA UGCAAAGCUUCUGAUGGAUCCUAAGAGGCAGAUCUUUUUAGAUCAAAACAUGCUGG CAGUUAUUGAUGAGCUGAUGCAGGCCCUGAAUUUCAACAGUGAGACGGUGCCACAA AAAUCCUCCCUUGAAGAACCAGAUUUCUACAAGACCAAGAUCAAGCUCUGCAUACU UCUUCAUGCUUUCAGAAUUCGGGCAGUGACUAUUGAUAGAGUGAUGAGCUAUCUGA AUGCUUCCUGAUAAUAGGCUGGAGCCUCGGUGGCCAUGCUUCUUGCCCCUUGGGCC UCCCCCCAGCCCCUCCUCCCCUUCCUGCACCCGUACCCCCCAAACACCAUUGUCAC ACUCCAGUGGUCUUUGAAUAAAGUCUGAGUGGGCGGC |
| 335 | hIL12AB_004 (5'UTR ORF 3'UTR) | UCAAGCUUUUGGACCCUCGUACAGAAGCUAAUACGACUCACUAUAGGGAAAUAAGA GAGAAAAGAAGAGUAAGAAGAAAUAUAAGAGCCACCAUGGGCUGCCACCAGCAGCU GGUCAUCAGCUGGUUCUCCCUGGUGUUCCUGGCCAGCCCCCUGGUGGCCAUCUGGG AGCUGAAGAAAGACGUCUACGUAGUAGAGUUGGAUUGGUACCCAGACGCACCUGGA GAAAUGGUGGUUCUCACCUGUGACACGCCAGAAGAAGACGGUAUCACCUGGACGCU GGACCAGAGCUCAGAAGUUCUUGGCAGUGGAAAACGCUGACCAUACAAGUAAAAG AAUUUGGGGAUGCUGGCCAGUACACCUGCCACAAAGGAGGAGAAGUUCUCAGCCAC AGCCUGCUGCUGCUGCACAAGAAAGAAGAUGGCAUCUGGAGCACAGAUAUUUUAAA AGACCAGAAGGAGCCCAAGAACAAAACCUUCCUUCGAUGUGAGGCCAAGAACUACA GUGGCCGCUUCACCUGCUGGUGGCUCACCACCAUCAGCACAGACCUCACCUUCUCG GUGAAGAGCAGCCGUGGCAGCUCAGACCCCCAAGGAGUCACCUGUGGGGCGGCCAC GCUGUCGGCAGAAAGAGUUCGAGGUGACAACAAGGAAUAUGAAUACUCGGUGGAAU GUCAAGAAGAUUCGGCCUGCCGGCGGCAGAAGAAAGUCUUCCCAUAGAAGUCAUG GUGGAUGCUGUUCACAAAUUAAAAUAUGAAAACUACACCAGCAGCUUCUUCAUCAG AGAUAUCAUCAAGCCAGACCCGCCCAAGAACCUGCAGCUGAAGCCCCUGAAGAACA GCCGGCAGGUGGAAGUUUCCUGGGAGUACCCAGAUACGUGGAGCACGCCGCACAGC UACUUCAGCCUCACCUUCUGUGUACAAGUACAAGGCAAGAGCAAGAGAGAGAAGAA AGAUCGUGUCUUCACAGAUAAAACCUCGGCGACGGUCAUCUGCAGGAAGAAUGCCU CCAUCUCGGUUCGAGCCCAGGACCGCUACUACAGCAGCAGCUGGAGUGAGUGGGCC |

| SEQ ID NO | Description | Sequence |
|---|---|---|
| | | UCGGUGCCCUGCAGUGGUGGCGGCGGCGGCAGCAGAAACCUUCCUGUGGCCAC GCCGGACCCUGGCAUGUUCCCGUGCCUGCACCACAGCCAAAAUUUACUUCGAGCUG UUUCUAACAUGCUGCAGAAAGCACGGCAAACUUUAGAAUUCUACCCCUGCACCUCA GAAGAAAUAGACCAUGAAGAUAUCACCAAAGAUAAAACCAGCACUGUAGAGGCCUG CCUGCCCCUGGAGCUCACCAAGAAUGAAUCCUGCCUCAACAGCAGAGAGACCAGCU UCAUCACCAAUGGCAGCUGCCUGGCCAGCAGGAAAACCAGCUUCAUGAUGGCGCUC UGCCUGAGCAGCAUCUAUGAAGAUUUGAAGAUGUACCAAGUAGAAUUUAAAACCAU GAAUGCCAAGCUGCUCAUGGACCCCAAGCGGCAGAUAUUUUUGGAUCAAAACAUGC UGGCUGUCAUUGAUGAGCUCAUGCAAGCAUUAAACUUCAACUCAGAGACGGUGCCC CAGAAGAGCAGCCUGGAGGAGCCAGAUUUCUACAAAACCAAGAUCAAGCUCUGCAU CUUAUUACAUGCCUUCCGCAUCCGGGCGGUCACCAUUGACCGUGUCAUGUCCUACU UAAAUGCCAGCUGAUAAUAGGCUGGAGCCUCGGUGGCCAUGCUUCUUGCCCCUUGG GCCUCCCCCAGCCCCUCCUCCCCUUCCUGCACCCGUACCCCCCAAACACCAUUGU CACACUCCAGUGGUCUUUGAAUAAAGUCUGAGUGGGCGGC |
| 336 | hIL12AB_005 (5'UTR ORF 3'UTR) | UCAAGCUUUUGGACCCUCGUACAGAAGCUAAUACGACUCACUAUAGGGAAAUAAGA GAGAAAAGAAGAGUAAGAAGAAAUAUAAGAGCCACCAUGUGCCACCAGCAGCUGGU CAUCAGCUGGUUCUCCCUGGUCUUCCUGGCCAGCCCCCUGGUGGCCAUCUGGGAGC UGAAGAAAGACGUCUACGUAGUAGAGUUGGAUUGGUACCCAGACGCACCUGGAGAA AUGGUGGUUCUCACCUGUGACACGCCAGAAGAAGACGGUAUCACCUGGACGCUGGA CCAGAGCUCAGAAGUUCUUGGCAGUGGAAAAACGCUGACCAUACAAGUAAAAGAAU UUGGGGAUGCUGGCCAGUACACCUGCCACAAAGGAGGAGAAGUUCUCAGCCACAGC CUGCUGCUGCUGCACAAGAAAGAAGAUGGCAUCUGGAGCACAGAUAUUUUAAAAGA CCAGAAGGAGCCCAAGAACAAAACCUUCCUUCGAUGUGAGGCCAAGAACUACAGUG GCCGCUUCACCUGCUGGUGGCUCACCACCAUCAGCACAGACCUCACCUUCUCGGUG AAGAGCAGCCGUGGCAGCUCAGACCCCCAAGGAGUCACCUGUGGGGCGGCCACGCU GUCGGCAGAAAGAGUUCGAGGUGACAACAAGGAAUAUGAAUACUCGGUGGAAUGUC AAGGAGAUUCGGCCUGCCCGGCGGCAGAAGAAAGUCUUCCCAUAGAAGUCAUGGUG GAUGCUGUUCACAAAUUAAAAUAUGAAAACUACACCAGCAGCUUCUUCAUCAGAGA UAUCAUCAAGCCAGACCCGCCCAAGAACCUGCAGCUGAAGCCCCUGAAGAACAGCC GGCAGGUGGAAGUUUCCUGGGAGUACCCAGAUACGUGGAGCACGCCGCACAGCUAC UUCAGCCUCACCUUCUGUGUACAAGUACAAGGCAAGAGCAAGAGAGAAGAAAGA UCGUGUCUUCACAGAUAAAACCUCGGCGACGGUCAUCUGCAGGAAGAAUGCCUCCA UCUCGGUUCGAGCCCAGGACCGCUACUACAGCAGCAGCUGGAGUGAGUGGGCCUCG GUGCCCUGCAGUGGUGGCGGCGGCGGCAGCAGAAACCUUCCUGUGGCCACGCC GGACCCUGGCAUGUUCCCGUGCCUGCACCACAGCCAAAAUUUACUUCGAGCUGUUU CUAACAUGCUGCAGAAAGCACGGCAAACUUUAGAAUUCUACCCCUGCACCUCAGAA GAAAUAGACCAUGAAGAUAUCACCAAAGAUAAAACCAGCACUGUAGAGGCCUGCCU GCCCCUGGAGCUCACCAAGAAUGAAUCCUGCCUCAACAGCAGAGAGACCAGCUUCA UCACCAAUGGCAGCUGCCUGGCCAGCAGGAAAACCAGCUUCAUGAUGGCGCUCUGC CUGAGCAGCAUCUAUGAAGAUUUGAAGAUGUACCAAGUAGAAUUUAAAACCAUGAA UGCCAAGCUGCUCAUGGACCCCAAGCGGCAGAUAUUUUUGGAUCAAAACAUGCUGG CUGUCAUUGAUGAGCUCAUGCAAGCAUUAAACUUCAACUCAGAGACGGUGCCCAG AAGAGCAGCCUGGAGGAGCCAGAUUUCUACAAAACCAAGAUCAAGCUCUGCAUCUU AUUACAUGCCUUCCGCAUCCGGGCGGUCACCAUUGACCGUGUCAUGUCCUACUUAA AUGCCAGCUGAUAAUAGGCUGGAGCCUCGGUGGCCAUGCUUCUUGCCCCUUGGGCC UCCCCCAGCCCCUCCUCCCCUUCCUGCACCCGUACCCCCCAAACACCAUUGUCAC ACUCCAGUGGUCUUUGAAUAAAGUCUGAGUGGGCGGC |
| 337 | hIL12AB_006 (5'UTR ORF 3'UTR) | UCAAGCUUUUGGACCCUCGUACAGAAGCUAAUACGACUCACUAUAGGGAAAUAAGA GAGAAAAGAAGAGUAAGAAGAAAUAUAAGAGCCACCAUGUGCCACCAGCAGCUGGU GAUCAGCUGGUUCAGCCUGGUGUUCCUGGCCAGCCCCCUGGUGGCCAUCUGGGAGC UGAAGAAGGACGUGUACGUGGUGGAGUUGGAUUGGUACCCCGACGCCCCCGGCGAG AUGGUGGUGCUGACCUGUGACACCCCCGAGGAGGACGGCAUCACCUGGACCCUGGA CCAGAGCAGCGAGGUGCUGGGCAGCGGCAAGACCCUGACCAUCCAGGUGAAGGAGU UCGGGGACGCCGGCCAGUACACCUGCCACAAGGGCGGCGAGGUGCUGAGCCACAGC CUGCUGCUGCUGCACAAGAAGGAGGACGGCAUCUGGAGCACAGAUAUUCUGAAGGA CCAGAAGGAGCCCAAGAACAAGACCUUCCUGAGAUGCGAGGCCAAGAACUACAGCG GCAGAUUCACCUGCUGGUGGCUGACCACCAUCAGCACAGAUUUGACCUUCAGCGUG AAGAGCAGCAGAGGCAGCAGCGACCCCCAGGGCGUGACCUGCGGCGCCGCCACCCU GAGCGCCGAGAGAGUGAGAGGUGACAACAAGGAGUACGAGUACAGCGUGGAGUGCC AGGAAGAUAGCGCCUGCCCCGCCGCCGAGGAGAGCCUGCCCAUCGAGGUGAUGGUG GACGCCGUGCACAAGCUGAAGUACGAGAACUACACCAGCAGCUUCUUCAUCAGAGA UAUCAUCAAGCCCGACCCGCCGAAGAACCUGCAGCUGAAGCCCCUGAAGAACAGCC GGCAGGUGGAGGUGAGCUGGGAGUACCCCGACACCUGGAGCACCCCCCACAGCUAC UUCAGCCUGACCUUCUGCGUGCAGGUGCAGGGCAAGAGCAAGAGAGAAGAAAGA UAGAGUGUUCACAGAUAAGACCAGCGCCACCGUGAUCUGCAGAAAGAACGCCAGCA UCAGCGUGAGAGCCCAAGAUAGAUACUACAGCAGCAGCUGGAGCGAGUGGGCCAGC GUGCCCUGCAGCGGCGGCGGCGGCGGCAGCAGAAACCUGCCCGUGGCCACCCC CGACCCCGGCAUGUUCCCCUGCCUGCACCACAGCCAGAACCUGCUGAGAGCCGUGA GCAACAUGCUGCAGAAGGCCCGGCAGACCCUGGAGUUCUACCCCUGCACCAGCGAG GAGAUCGACCACGAAGAUAUCACCAAAGAUAAGACCAGCACCGUGGAGGCCUGCCU GCCCCUGGAGCUGACCAAGAAUGAAAGCUGCCUGAACAGCAGAGAGACCAGCUUCA |

| SEQ ID NO | Description | Sequence |
|---|---|---|
| | | UCACCAACGGCAGCUGCCUGGCCAGCAGAAAGACCAGCUUCAUGAUGGCCCUGUGC<br>CUGAGCAGCAUCUACGAGGACCUGAAGAUGUACCAGGUGGAGUUCAAGACCAUGAA<br>CGCCAAGCUGCUGAUGGACCCCAAGCGGCAGAUCUUCCUGGACCAGAACAUGCUGG<br>CCGUGAUCGACGAGCUGAUGCAGGCCCUGAACUUCAACAGCGAGACCGUGCCCCAG<br>AAGAGCAGCCUGGAGGAGCCCGACUUCUACAAGACCAAGAUCAAGCUGUGCAUCCU<br>GCUGCACGCCUUCAGAAUCAGAGCCGUGACCAUCGACAGAGUGAUGAGCUACCUGA<br>ACGCCAGCUGAUAAUAGGCUGGAGCCUCGGUGGCCAUGCUUCUUGCCCCUUGGGCC<br>UCCCCCCAGCCCCUCCUCCCCUUCCUGCACCCGUACCCCCCAAACACCAUUGUCAC<br>ACUCCAGUGGUCUUUGAAUAAAGUCUGAGUGGGCGGC |
| 338 | hIL12AB_007<br>(5'UTR ORF<br>3'UTR) | UCAAGCUUUUGGACCCUCGUACAGAAGCUAAUACGACUCACUAUAGGGAAAUAAGA<br>GAGAAAAGAAGAGUAAGAAGAAAUAUAAGAGCCACCAUGUGCCACCAGCAGCUUGU<br>CAUCUCCUGGUUCUCUCUUGUCUUCCUUGCUUCUCCUCUUGUGGCCAUCUGGGAGC<br>UGAAGAAGGACGUUUACGUAGUGGAGUUGGAUUGGUACCCUGACGCACCUGGAGAA<br>AUGGUGGUUCUCACCUGUGACACUCCUGAGGAGGACGGUAUCACCUGGACGUUGGA<br>CCAGUCUUCUGAGGUUCUUGGCAGUGGAAAAACUCUUACUAUUCAGGUGAAGGAGU<br>UGGAGAUGCUGGCCAGUACACCUGCCACAAGGGUGGUGAAGUUCUCAGCCACAGU<br>UUACUUCUUCUUCACAAGAAGGAGGAUGGCAUCUGGUCUACUGACAUUUUAAAAGA<br>CCAGAAGGAGCCCAAGAACAAAACAUUCCUUCGUUGUGAAGCCAAGAACUACAGUG<br>GUCGUUUCACCUGCUGGUGGCUUACUACAUUUCUACUGACCUUACUUUCUCUGUG<br>AAGUCUUCUCUGGGCUCUUCUGACCCUCAGGGUGUCACCGUGGGGCUGCUACUCU<br>UUCUGCUGAGCGUGUGCGUGGUGACAACAAGGAGUAUGAAUACUCGGUGGAGUGCC<br>AGGAAGAUUCUGCCUGCCCUGCUGCUGAGGAGUCUCUUCCUAUUGAGGUGAUGGUG<br>GAUGCUGUGCACAAGUUAAAAUAUGAAAACUACACUUCUUUCUUCAUUCGUGA<br>CAUUAUAAAACCUGACCCUCCCAAGAACCUUCAGUUAAAACCUUUUAAAAAACUCUC<br>UCAGGUGGAGGUGUCCUGGGAGUACCCUGACACGUGGUCUACUCCUCACUCCUAC<br>UUCUCUCUUACUUUCUGUGUCCAGGUGCAGGGCAAGUCCAAGCUGAGAAGAAGGA<br>CCGUGUCUUCACUGACAAAACAUCUGCUACUCUGCAGGAAGAAUGCAUCCA<br>UCUCUGUGCGUGCUCAGGACCGUUACUACAGCUCUUCCUGGUCUGAGUGGGCUUCU<br>GUGCCCUGCUCUGGCGGCGGCGGCGGCAGCAGAAAUCUUCCUGUUGGCUACUCC<br>UGACCCUGGCAUGUUCCCCUGCCUUCACCACUCGCAGAACCUUCUUCGUGCUGUGA<br>GCAACAUGCUUCAGAAGGCUCGUCAAACUUUAGAAUUCUACCCCUGCACUUCUGAG<br>GAGAUUGACCAUGAAGAUAUCACCAAAGAUAAAACAUCUACUGUGGAGGCCUGCCU<br>UCCUUUAGAGCUGACCAAGAAUGAAUCCUGCUUAAAUUCUCUGUGAGACGUCUUUCA<br>UCACCAAUGGCAGCUGCCUUGCCUCGCGCAAAACAUCUUUCAUGAUGGCUCUUUGC<br>CUUUCUUCCAUCUAUGAAGAUUUAAAAAAUGUACCAGGUGGAGUUCAAGACCAUGAA<br>UGCAAAGCUUCUCAUGGACCCCAAGCGUCAGAUAUUUUUGGACCAGAACAUGCUUG<br>CUGUCAUUGAUGAGCUCAUGCAGGCUUUAAACUUCAACUCUGAGACGGUGCCUCAG<br>AAGUCUUCUUUAGAAGAGCCUGACUUCUACAAGACCAAGAUAAAACUUUGCAUUCU<br>UCUUCAUGCUUUCCGCAUCCGUGCUGUGACUAUUGACCGUGUGAUGUCCUACUUAA<br>AUGCUUCUUGAUAAUAGGCUGGAGCCUCGGUGGCCAAGCUUCUUGCCCCUUGGGCC<br>UCCCCCCAGCCCCUCCUCCCCUUCCUGCACCCGUACCCCCCAAACACCAUUGUCAC<br>ACUCCAGUGGUCUUUGAAUAAAGUCUGAGUGGGCGGC |
| 339 | hIL12AB_008<br>(5'UTR ORF<br>3'UTR) | UCAAGCUUUUGGACCCUCGUACAGAAGCUAAUACGACUCACUAUAGGGAAAUAAGA<br>GAGAAAAGAAGAGUAAGAAGAAAUAUAAGAGCCACCAUGUGUCAUCAACAACUCGU<br>GAUUAGCUGGUUCAGUCUCGUGUUCCUGGCCUCUCCGCUGGUGGCCAUCUGGGAGC<br>UUAAGAAGGACGUGUACGUGGUGGAGCUCGAUUGGUACCCCGACGCACCUGGCGAG<br>AUGGUGGUGCUAACCUGCGAUACCCCCGAGGAGGACGGGAUCACUUGGACCCUGGA<br>UCAGAGUAGCGAAGUCCUGGGCUCUGGCAAAACACUCACAAUCCAGGUGAAGGAAU<br>UCGGAGACGCUGGUCAGUACACUUGCCACAAGGGGGGUGAAGUGCUGUCUCACAGC<br>CUGCUGUUACUGCACAAGAAGGAGGAUGGGAUCUGGUCAACCGACAUCCUGAAGGA<br>UCAGAAGGAGCCUAAGAACAAGACCUUUCUGAGGUGUGAAGCCUAAGAACUAUUCCG<br>GAAGAUUCACUUGCUGGUGGUUGACCACAAUCAGCACUGACCUGACCUUUUCCGUG<br>AAGUCCAGCAGAGGAAGCAGCGAUCCUCAGGGCGUAACGUGCGGCGCGGCUACCCU<br>GUCAGCUGAGCGGGUUAGAGGCGACAACAAAGAGUAUGAGUACUCCGUGGAGUGUC<br>AGGAAGAUAGCGCCUGCCCCGCAGCCGAGGAGAGUCUGCCCAUCGAGGUGAUGGUG<br>GACGCUGUCCAUAAGUUAAAAUACGAAAAUUACACAAGUUCCUUUUUCAUCCGCGA<br>UAUUAUCAAACCCGAUCCCCCCAAGAACCUGCAGCUGAAGCCCUGAAGAAUAGCC<br>GACAGGUGGAAGUCUCUUGGGAGUAUCCUGACACCUGGUCCACGCCUCACAGCUAC<br>UUUAGCUGACUUUCUGUGUCCAGGUCCAGGGCAAGAGCAAGAGAGAGAAAAGGA<br>UAGAGUGUUUACUGACAAAACAUCUGCUACAGUCAUCUGCAGAAAGAACGCCAGUA<br>UCUCAGUGAGGGCGCAAGAUAGAUACUACAGUAGUAGCUGGAGCGAAUGGGCUAGC<br>GUGCCCUGUUCAGGGGCGGCGGAGGGGCUCCAGGAAUCUGCCCGUGGCCACCCC<br>CGACCCUGGGAUGUUCCCUUGCCUCCAUCACUCACAGAACCUGCUCAGAGCAGUGA<br>GCAACAUGCUCCAAAAGGCCCGCCAGACCCUGGAGUUUUACCCUUGUACUUCAGAA<br>GAGAUCGAUCACGAAGAUAUAACAAAGGAUAAAACCAGCACCGUGGAGGCCUGUCU<br>GCCUCUGGAACUCACAAAGAAUGAAAGCUGUCUGAAUUCCAGGGAAACCUCCUUCA<br>UUACUAACGGAAGCUGUCUCGCAUCUCGCAAAACAUCAUUCAUGAUGGCCCUCUGC<br>CUGUCUUCUAUCUAUGAAGAUCUCAAGAUGUAUCAGGUGGAGUUCAAACAAUGAA<br>CGCCAAGCUGCUGAUGGACCCCAAGCGGCAGAUCUUCCUGGACCAGAACAUGCUGG<br>CAGUGAUCGAUGAGCUGAUGCAAGCCUUGAACUUCAACUCAGAGACGGUGCCGCAA<br>AAGUCCUCGUUGGAGGAACCAGAUUUUUACAAAACCAAAAUCAAGCUGUGUAUCCU |

SUMMARY OF SEQUENCES

| SEQ ID NO | Description | Sequence |
|---|---|---|
| | | UCUUCACGCCUUUCGGAUCAGAGCCGUGACUAUCGACCGGGUGAUGUCAUACCUGA<br>AUGCUUCCUGAUAAUAGGCUGGAGCCUCGGUGGCCAUGCUUCUUGCCCCUUGGGCC<br>UCCCCCCAGCCCCUCCUCCCCUUCCUGCACCCGUACCCCCCAAACACCAUUGUCAC<br>ACUCCAGUGGUCUUUGAAUAAAGUCUGAGUGGGCGGC |
| 340 | hIL12AB_009<br>(5'UTR ORF<br>3'UTR) | UCAAGCUUUUGGACCCUCGUACAGAAGCUAAUACGACUCACUAUAGGGAAAUAAGA<br>GAGAAAAGAAGAGUAAGAAGAAAUAUAAGAGCCACCAUGUGCCACCAGCAGCUGGU<br>CAUCAGCUGGUUUUAGCCUGGUCUUCCUGGCCAGCCCCCUGGUGGCCAUCUGGGAGC<br>UGAAGAAAGACGUCUACGUAGUAGAGUUGGAUUGGUACCCAGACGCACCUGGAGAA<br>AUGGUGGUUCUCACCUGCGACACGCCAGAAGAAGACGGUAUCACCUGGACGCUGGA<br>CCAGAGCAGCGAAGUACUGGGCAGUGGAAAAACGCUGACCAUACAAGUAAAAGAAU<br>UUGGCGAUGCUGGCCAGUACACCUGCCACAAAGGAGGAGAAGUACUGAGCCACAGC<br>CUGCUGCUGCUGCACAAGAAAGAAGAUGGCAUCUGGAGCACCGACAUUUUAAAAGA<br>CCAGAAGGAGCCCAAGAACAAAACCUUCCUUCGAUGUGAGGCGAAGAACUACAGUG<br>GCCGCUUCACCUGCUGGUGGCUCACCACCAUCAGCACCGACCUCACCUUCUCGGUG<br>AAGAGCAGCCGUGGUAGCUCAGACCCCCAAGGAGUCACCUGUGGGGCGGCCACGCU<br>GUCGGCAGAAAGAGUUCGAGGCGACAACAAGGAAUAUGAAUACUCGGUGGAAUGUC<br>AAGAAGAUUCGGCCUGCCCGGCGGCAGAAGAAAGUCUGCCCAUAGAAGUCAUGGUG<br>GAUGCUGUUCACAAAUUAAAAUAUGAAAACUACACCAGCAGCUUCUUCAUCAGAGA<br>UAUCAUCAAGCCAGACCCCCCUCAAGAACCUGCAGCUGAACCCCUGAAGAACAGCC<br>GGCAGGUGGAAGUUUCCUGGGAGUACCCAGAUACGUGGAGCACGCCGCACAGCUAC<br>UUCAGCCUCACCUUCUGUGUACAAGUACAAGGCAAGAGCAAGAGAGAGAAGAAAGA<br>UCGUGUCUUCACCGACAAAACCUCGGCGACGGUCAUCUGCAGGAAGAAUGCAAGCA<br>UCUCGGUUCGAGCCCAGGACCGCUACUACAGCAGCAGCUGGAGUGAGUGGGCCUCG<br>GUGCCCUGCAGUGGUGGCGGCGGCGGCAGCAGAAACCUUCCUGUGGCCACGCC<br>GGACCCUGGCAUGUUCCGUGCCUGCACCACAGCCAAAAUUUAUUACGAGCUGUUA<br>GCAACAUGCUGCAGAAAGCACGGCAAACUUUAGAAUUCUACCCCUGCACCUCAGAA<br>GAAAUAGACCAUGAAGAUAUCACCAAAGAUAAAACCAGCACUGUAGAGGCCUGCCU<br>GCCCCUGGAGCUCACCAAGAACGAGAGCUGCCUCAAUAGCAGAGAGACCAGCUUCA<br>UCACCAAUGGCAGCUGCCUGGCCAGCAGGAAAACCAGCUUCAUGAUGGCGCUCUGC<br>CUGAGCAGCAUCUAUGAAGAUCUGAAGAUGUACCAAGUAGAAUUUAAAACCAUGAA<br>UGCCAAGCUGCUCAUGGACCCCAAGCGGCAGAUAUUCCUCGACCAAAACAUGCUGG<br>CUGUCAUUGAUGAGCUCAUGCAAGCAUUAAACUUCAACUCAGAGACGGUGCCCCAG<br>AAGAGCAGCCUGGAGGAGCCAGAUUUCUACAAAACCAAGAUCAAGCUCUGCAUCUU<br>AUUACAUGCCUUCCGCAUCCGGGCGGUCACCAUUGACCGUGUCAUGUCCUACUUAA<br>AUGCCAGCUGAUAAUAGGCUGGAGCCUCGGUGGCCAUGCUUCUUGCCCCUUGGGCC<br>UCCCCCCAGCCCCUCCUCCCCUUCCUGCACCCGUACCCCCCAAACACCAUUGUCAC<br>ACUCCAGUGGUCUUUGAAUAAAGUCUGAGUGGGCGGC |
| 341 | hIL12AB_010<br>(5'UTR ORF<br>3'UTR) | UCAAGCUUUUGGACCCUCGUACAGAAGCUAAUACGACUCACUAUAGGGAAAUAAGA<br>GAGAAAAGAAGAGUAAGAAGAAAUAUAAGAGCCACCAUGUGCCACCAGCAGCUGUU<br>CAUCUCCUGGUUUUCUCUUGUCUUCCUCGCUUCUCCUCUUGUGGCCAUCUGGGAGC<br>UGAAGAAAGACGUCUACGUAGUAGAGUUGGAUUGGUACCCGGACGCUCCUGGAGAA<br>AUGGUGGUUCUCACCUGCGACACUCCUGAAGAAGACGGUAUCACCUGGACGCUGGA<br>CCAAAGCAGCGAAGUUUUAGGCUCUGGAAAAACGCUGACCAUACAAGUAAAAGAAU<br>UUGGCGACGCUGGCCAGUACACGUGCCACAAAGGAGGAGAAGUUUUAAGCCACAGU<br>UUACUUCUUCUUCACAAGAAAGAAGAUGGCAUCUGGAGUACAGAUAUUUUAAAAGA<br>CCAGAAGGAGCCUAAGAACAAAACCUUCCUCCGCUGUGAAGCUAAGAACUACAGUG<br>GUCGUUUCACCUGCUGGUGGCUCACCACCAUCUCCACUGACCUCACCUUCUCUGUA<br>AAAUCAAGCCGUGGUUCUUCUGACCCCCAAGGAGUCACCUGUGGGGCUGCCACGCU<br>CAGCGCUGAAAGAGUUCGAGGCGACAACAAGGAAUAUGAAUAUUCCGUGGAAUGUC<br>AAGAAGAUUCUGCCUGCCCGGCGGCAGAAGAAAGUCUUCCCAUAGAAGUCAUGGUG<br>GACGCUGUUCACAAAUUAAAAUAUGAAAACUACACCAGCAGCUUCUUCAUUCGUGA<br>CAUCAUCAAACCAGACCCUCCUAAGAACCUUCAGUUAAAACCGCUGAAGAACAGCC<br>GGCAGGUGGAAGUUUCCUGGGAGUACCCAGAUACGUGGAGUACGCCGCACUCCUAC<br>UUCAGUUUAACCUUCUGUGUACAAGUACAAGGAAAAUCAAAAAGAGAAGAAAGA<br>UCGUGUCUUCACUGACAAAACAUCUGCCACGGUCAUCUGCCGUAAGAACGCUUCCA<br>UCUCGGUUCGAGCCCAGGACCGCUACUACAGCAGCAGCUGGAGUGAGUGGGCAUCU<br>GUUCCCUGCAGUGGUGGCGGCGGCGGCAGCCGCAACCUUCCUGUGGCCACGCC<br>GGACCCUGGCAUGUUCCCGUGCCUUCACCACUCGCAAAAUCUUCUUCGUGCUGUUU<br>CUAACAUGCUGCAGAAGGCGCGGCAAACUUUAGAAUUCUACCCUGCACUUCUGAA<br>GAAAUAGACCAUGAAGAUAUCACCAAAGAUAAAACCAGCACGGUGGAGGCCUGCCU<br>UCCUUUAGAACUUACUAAGAACGAAAGUUGCCUUAACAGCCGUGAGACCAGCUUCA<br>UCACCAAUGGCAGCUGCCUUGCUAGCAGGAAGACCAGCUUCAUGAUGGCGCUGUGC<br>CUUUCUUCCAUCUAUGAAGAUCUUAAGAUGUACCAAGUAGAAUUUAAAACCAUGAA<br>UGCCAAAUUAUUAAUGGACCCCAAGCGGCAGAUAUUCCUCGACCAAAACAUGCUGG<br>CUGUCAUUGAUGAGCUCAUGCAAGCAUUAAACUUCAACUCAGAAACUGUUCCCCAG<br>AAGUCAUCUUUAGAAGAACCAGAUUUCUACAAAACAAAAAUAAAACUCUGCAUUCU<br>UCUUCAUGCCUUCCGCAUCCGUCUGUCACCAUUGACCGUGUCAUGUCCUACUUAA<br>AUGCUUCUUGAUAAUAGGCUGGAGCCUCGGUGGCCAUGCUUCUUGCCCCUUGGGCC<br>UCCCCCCAGCCCCUCCUCCCCUUCCUGCACCCGUACCCCCCAAACACCAUUGUCAC<br>ACUCCAGUGGUCUUUGAAUAAAGUCUGAGUGGGCGGC |

SUMMARY OF SEQUENCES

| SEQ ID NO | Description | Sequence |
|---|---|---|
| 342 | hIL12AB_011 (5'UTR ORF 3'UTR) | UCAAGCUUUUGGACCCUCGUACAGAAGCUAAUACGACUCACUAUAGGGAAAUAAGA GAGAAAAGAAGAGUAAGAAGAAAUAUAAGAGCCACCAUGUGCCACCAGCAGCUGGU GAUCAGCUGGUUCAGCCUGGUGUUCCUGGCCAGCCCCUGGUGGCCAUCUGGGAGC UGAAGAAGGACGUGUACGUGGUGGAGUUGGAUUGGUACCCGGACGCGCCGGGGGAG AUGGUGGUGCUGACGUGCGACACGCCGGAGGAGGACGGGAUCACGUGGACGCUGGA CCAGAGCAGCGAGGUGCUGGGGAGCGGGAAGACGCUGACGAUCCAGGUGAAGGAGU UCGGGGACGCGGGGCAGUACACGUGCCACAAGGGGGGGAGGUGCUGAGCCACAGC CUGCUGCUGCUGCACAAGAAGGAGGACGGGAUCUGGAGCACAGAUAUCCUGAAGGA CCAGAAGGAGCCGAAGAACAAGACGUUCCUGAGGUGCGAGGCGAAGAACUACAGCG GGAGGUUCACGUGCUGGUGGCUGACGACGAUCAGCACGGACCUGACGUUCAGCGUG AAGAGCAGCAGGGGGAGCAGCGACCCGCAGGGGUGACGUGCGGGGCGGCGACGCU GAGCGCGGAGAGGGUGAGGGGUGACAACAAGGAGUACGAGUACAGCGUGGAGUGCC AGGAAGAUAGCGCGUGCCCGGCGGCGGAGGAGAGCCUGCCGAUCGAGGUGAUGGUG GACGCGGUGCACAAGCUGAAGUACGAGAACUACACGAGCAGCUUCUUCAUCAGAGA UAUCAUCAAGCCGGACCCCGCCGAAGAACCUGCAGCUGAAGCGCUGAAGAACAGCA GGCAGGUGGAGGUGAGCUGGGAGUACCCAGAUACGUGGAGCACGCCGCCACAGCUAC UUCAGCCUGACGUUCUGCGUGCAGGUGCAGGGGAAGAGCAAGAGGGAGAAGAAAGA UAGGGUGUUCACAGAUAAGACGAGCGCGACGGUGAUCUGCAGGAAGAACGCGAGCA UCAGCGUGAGGGCGCAAGAUAGGUACUACAGCAGCAGCUGGAGCGAGUGGGCGAGC GUGCCGUGCAGCGGGGGGGGGGGGGAGCAGGAACCUGCCGGUGGCGACGCC GGACCCGGGGAUGUUCCCGUGCCUGCACCACAGCCAGAACCUGCUGAGGGCGGUGA GCAACAUGCUGCAGAAGGCGAGGCAGACGCUGGAGUUCUACCCGUGCACGAGCGAG GAGAUCGACCACGAAGAUAUCACGAAAGAUAAGACGAGCACGGUGGAGGCGUGCCU GCCGCUGGAGCUGACGAAGAACGAGAGCUGCCUGAACAGCAGGGAGACGAGCUUCA UCACGAACGGGAGCUGCCUGGCGAGCAGGAAGACGAGCUUCAUGAUGGCGCUGUGC CUGAGCAGCAUCUACGAGGACCUGAAGAUGUACCAGGUGGAGUUCAAGACGAUGAA CGCGAAGCUGCUGAUGGACCCGAAGAGGCAGAUCUUCCUGGACCAGAACAUGCUGG CGGUGAUCGACGAGCUGAUGCAGGCGCUGAACUUCAACAGCGAGACGGUGCCGCAG AAGAGCAGCCUGGAGGAGCCAGAUUUCUACAAGACGAAGAUCAAGCUGUGCAUCCU GCUGCACGCGUUCAGGAUCAGGGCGGUGACGAUCGACAGGGUGAUGAGCUACCUGA ACGCGAGCUGAUAAUAGGCUGGAGCCUCGGUGGCCAUGCUUCUUGCCCCUUGGGCC UCCCCCCAGCCCCUCCUCCCCUUCCUGCACCCGUACCCCCCAAACACCAUUGUCAC ACUCCAGUGGUCUUUGAAUAAAGUCUGAGUGGGCGGC |
| 343 | hIL12AB_012 (5'UTR ORF 3'UTR) | UCAAGCUUUUGGACCCUCGUACAGAAGCUAAUACGACUCACUAUAGGGAAAUAAGA GAGAAAAGAAGAGUAAGAAGAAAUAUAAGAGCCACCAUGUGCCAUCAGCAGCUGGU GAUCAGCUGGUUCAGCCUCGUGUUUCUGGCCAGCCCCUGGUGGCCAUUUGGGAAC UCAAGAAGGACGUGUACGUUGUGGAACUCGACUGGUACCCUGACGCCCCAGGCGAA AUGGUGGUCUUAACCUGCGACACCCCUGAGGAGGACGGAAUCACCUGGACCUUGGA CCAGAGCUCCGAGGUCCUCGGCAGUGGCAAGACCCUGACCAUACAGGUGAAAGAAU UUGGAGACGCAGGGCAAUACACAUGUCACAAGGGCGGGGAGGUUCUUUCUCACUCC CUUCUGCUUCUACAUAAAAAGGAAGACGGAAUUUGGUCUACCGACAUCCUCAAGGA CCAAAAGGAGCCUAAGAAUAAAACCUUCUUACGCUGUGAAGCUAAAAACUACAGCG GCAGAUUCACUUGCUGGUGGCUCACCACCAUUUCUACCGACCUGACCUUCUCGGUG AAGUCUUCAAGGGGCUCUAGUGAUCCACAGGGAGUGACAUGCGGGGCCGCCACACU GAGCGCUGAACGGGUGAGGGGCGAUAACAAGGAGUAUGAAUACUCUGUCGAGUGUC AGGAGGAUUCAGCUUGUCCCGCAGCUGAAGAGUCACUCCCCAUAGAGGUUAUGGUC GAUGCUGUGCAUAAACUGAAGUACGAAACUACACCAGCAGCUUCUUCAUUAGAGA UAUUAUAAAAACCUGACCCCCCCAAGAACCUGCAACUUAAACCCCUGAAAAACUCUC GGCAGGUCGAAGUUAGCUGGGAGUACCCUGAUACUUGGUCCACCCCCCACUCGUAC UUCUCACUGACUUUCUGUGUGCAGGUGCAGGCAAGAGCAAGAGAGAGAAAAAGA UCGUGUAUUCACAGAUAAGACCUCUGCCACCGUGAUCUGCAGAAAAAACGCUUCCA UCAGUGUCAGAGCCCAAGACCGGUACUAUAGUAGUAGCUGGAGCGAGUGGGCCAAGU GUCCCCUGCUCUGGCGGCGGAGGGGGCGGCUCUCGAAACCUCCCCGUCGCUACCCC UGAUCCAGGAAUGUUCCCUUGCCUGCAUCACUCACAGAAUCUGCUGAGAGCGGUCA GCAACAUGCUGCAGAAAGCUAGGCAAACACUGGAGUUUUAUCCUUGUACCUCAGAG GAGAUCGACCACGAGGAUAUUACAAAGAUAAGACCAGCACGGUGGAGGCCUGCUU GCCCCUGGAACUGACAAAGAAUGAAUCCUGCCUUAAUAGCCGUGAGACCUCUUUUA UAACAAACGGAUCCUGCCUGGCCAGCAGGAAGACCUCCUUCAUGAUGGCCCUCUGC CUGUCCUCAAUCUACGAAGACCUGAAGAUGUACCAGGUGGAAUUUAAAACUAUGAA CGCCAAGCUGUUGAUGGACCCCAAGCGGCAGAUCUUUCUGGAUCAAAAUAUGCUGG CUGUGAUCGACGAACUGAUGCAGGCCCUCAACUUUAACAGCGAGACCGUGCCACAA AAGAGCAGUCUUGAGGAGCCCGACUUCUACAAGACCAAGAUCAAGCUGUGCAUCCU CCUUCAUGCCUUCAGGAUAAGAGCUGUCACCAUCGACAGAGUCAUGAGUUACCUGA AUGCAUCCUGAUAAUAGGCUGGAGCCUCGGUGGCCAUGCUUCUUGCCCCUUGGGCC UCCCCCCAGCCCCUCCUCCCCUUCCUGCACCCGUACCCCCCAAACACCAUUGUCAC ACUCCAGUGGUCUUUGAAUAAAGUCUGAGUGGGCGGC |
| 344 | hIL12AB_013 (5'UTR ORF 3'UTR) | UCAAGCUUUUGGACCCUCGUACAGAAGCUAAUACGACUCACUAUAGGGAAAUAAGA GAGAAAAGAAGAGUAAGAAGAAAUAUAAGAGCCACCAUGUGCCACCAGCAGCUGGU CAUCUCCUGGUUCAGCUUUGUCUUCCUGGCCUCGCCGCUGGUGGCCAUCUGGGAGC UGAAGAAGACGUUUACGUAGUAGAGUUGGAUUGGUACCCAGACGCACCUGGAGAA AUGGUGGUCCUCACCUGUGACACGCCAGAAGAAGACGGUAUCACCUGGACGCUGGA |

SUMMARY OF SEQUENCES

| SEQ ID NO | Description | Sequence |
|---|---|---|
| | | CCAGAGCAGUGAAGUUCUUGGAAGUGGAAAAACGCUGACCAUACAAGUAAAAGAAU<br>UUGGAGAUGCUGGCCAGUACACCUGCCACAAAGGAGGAGAAGUUCUCAGCCACAGU<br>UUAUUAUUACUUCACAAGAAAGAAGAUGGCAUCUGGUCCACAGAUAUUUUAAAAGA<br>CCAGAAGGAGCCCAAAAAUAAAACAUUUCUUCGAUGUGAGGCCAAGAACUACAGUG<br>GUCGUUUCACCUGCUGGUGGCUGACCACCAUCUCCACAGACCUCACCUUCAGUGUA<br>AAAAGCAGCCGUGGUUCUUCUGACCCCCAAGGAGUCACCUGUGGGGCUGCCACGCU<br>CUCUGCAGAAAGAGUUCGAGGUGACAACAAAGAAUAUGAGUACUCGGUGGAAUGUC<br>AAGAAGAUUCGGCCUGCCCAGCUGCUGAGGAGAGUCUUCCCAUAGAAGUCAUGGUG<br>GAUGCUGUUCACAAAUUAAAAUAUGAAAACUACACCAGCAGCUUCUUCAUCAGAGA<br>UAUCAUCAAACCUGACCCGCCCAAGAACUUACAGCUGAAGCCGCUGAAAAACAGCC<br>GGCAGGUAGAAGUUUCCUGGGAGUACCCAGAUACCUGGUCCACGCCGCACUCCUAC<br>UUCUCCCUCACCUUCUGUGUACAAGUACAAGGCAAGAGCAAGAGAGAGAAGAAAGA<br>UCGUGUCUUCACAGAUAAAACAUCAGCCACGGUCAUCUGCAGGAAAAAUGCCAGCA<br>UCUCGGUGCGGGCCCAGGACCGCUACUACAGCAGCAGCUGGAGUGAGUGGGCAUCU<br>GUGCCCUGCAGUGGUGGUGGGGGUGGUGGCAGCAGAAACCUUCCUGUGGCCACUCC<br>AGACCCUGGCAUGUUCCCGUGCCUUCACCACUCCCAAAAUUUACUUCGAGCUGUUU<br>CUAACAUGCUGCAGAAAGCACGGCAAACUUUAGAAUUCUACCCGUGCACUUCUGAA<br>GAAAUUGACCAUGAAGAUAUCACAAAAGAUAAAACCAGCACAGUGGAGGCCUGUCU<br>UCCUUUAGAGCUGACCAAAAAUGAAUCCUGCCUCAACAGCAGAGAGACCAGCUUCA<br>UCACCAAUGGCAGCUGCCUGGCCUCCAGGAAAACCAGCUUCAUGAUGGCGCUCUGC<br>CUCAGCUCCAUCUAUGAAGAUUUGAAGAUGUACCAAGUAGAAUUUAAAACCAUGAA<br>UGCCAAAUUAUUAAUGGACCCCAAGAGGCAGAUAUUUUUAGAUCAAAACAUGCUGG<br>CAGUUAUUGAUGAGCUCAUGCAAGCAUUAAACUUCAACAGUGAGACGGUACCCUCAA<br>AAAAGCAGCCUUGAAGAGCCAGAUUUCUACAAAACCAAGAUCAAACUCUGCAUUUU<br>ACUUCAUGCCUUCCGCAUCCGGGCGGUCACCAUUGACCGUGUCAUGUCCUACUUAA<br>AUGCCUCGUGAUAAUAGGCUGGAGCCUCGGUGGCCAUGCUUCUUGCCCCUUGGGCC<br>UCCCCCCAGCCCCUCCUCCCCUUCCUGCACCCGUACCCCCCAAACACCAUUGUCAC<br>ACUCCAGUGGUCUUUGAAUAAAGUCUGAGUGGGCGGC |
| 345 | hIL12AB_014<br>(5'UTR ORF 3'UTR) | UCAAGCUUUUGGACCCUCGUACAGAAGCUAAUACGACUCACUAUAGGGAAAUAAGA<br>GAGAAAAGAAGAGUAAGAAGAAAUAUAAGAGCCACCAUGUGCCACCAGCAGCUUGU<br>GAUUUCUUGGUUCUCUCUUGUGUUCCUUGCUUCUCCUCUUGUGGCUAUUUGGGAGU<br>UAAAAAAGGACGUGUACGUGGUGGAGCUUGACUGGUACCCUGACGCACCUGGCGAG<br>AUGGUGGUGCUUACUGUGACACUCCUGAGGAGGACGGCAUUACUUGGACGCUUGA<br>CCAGUCUUCUGAGGUGCUUGGCUCUGGCAAAACACUUACUAUUCAGGUGAAGGAGU<br>UCGGGGAUGCUGGCCAGUACACUUUCCACAAGGGCGGCGAGGUGCUUUCUCACUCU<br>CUUCUUCUUCUUCACAAGAAGGAGGACGGCAUUUGGUCUACUGACAUUUUAAAAGA<br>CCAGAAGGAGCCCAAGAACAAAACAUUCCUUCGUUGCGAGGCCAAGAACUACUCUG<br>GCCGUUUCACUUGCUGGUGGCUUACUACUAUUUCUACUGACCUUACUUUCUCUGUG<br>AAGUCUUCUCUGUGGCUCUUCUGACCCUCAGGGCGUGACUUGUGGGGCUGCUACUCU<br>UUCUGCUGAGCGUGUGCGUGGUGACAACAAGGAGUACGAGUACUCUCGGUGGAGUGCC<br>AGGAAGAUUCUGCUUGCCCUGCUGCUGAGGAGUCUCUUCCUAUUGAGGUGAUGGUG<br>GAUGCUGUGCACAAGUUAAAAUACGAGAACUACACUUCUCUUUCUUCAUUCGUGA<br>CAUUAUUAAGCCUGACCCUCCCAAGAACCUUCAGUUAAAACCUUUAAAAAAACUCUC<br>GUCAGGUGGAGGUGUCUUGGGAGUACCCUGACACUUGGUCUACUCCUCACUCUUAC<br>UUCUCUCUUACUUUCUGCGUGCAGGUGCAGGGCAAGUCUAAGCGUGAGAAGAAGGA<br>CCGUGUGUUCACUGACAAAACAUCUGCUACUGUGAUUUGCAGGAAGAAUGCAUCUA<br>UUUCUGUGCGUGCUCAGGACCGUUACUACUCUUCUUCUUGGUCUGAGUGGGCUUCU<br>GUGCCUUGCUCUGGCGGCGGCGGCGGCGGCUCCAGAAAUCUUCCUGUGGCUACUCC<br>UGACCCUGGCAUGUUCCCUUGCCUUCACCACUCUCAGAACCUUCUUCGUGCUGUGA<br>GCAACAUGCUUCAGAAGGCUCGUCAAACUCUUGAGUUCUACCCUUGCACUUCUGAG<br>GAGAUUGACCACGAAGAUAUCACCAAAGAUAAAACAUCUACUGUGGAGGCUUGCCU<br>UCCUCUUGAGCUUACCAAGAAUGAAUCUUGCUUAAAUUCUCGUGAGACGUCUUUCA<br>UCACCAACGGCUCUUGCCUUGCCUCGCGCAAAACAUCUUUCAUGAUGGCUCUUUGC<br>CUUUCUUCUAUUUACGAAGAUUUAAAAAUGUACCAGGUGGAGUUCAAAACAAUGAA<br>UGCAAAGCUUCUUAUGGACCCCAAGCGUCAGAUUUUCCUUGACCAGAACAUGCUUG<br>CUGUGAUUGACGAGCUUAUGCAGGCUUUAAAUUUCAACUCUGAGACGGUGCCUCAG<br>AAGUCUUCUCUUGAGGAGCCUGACUUCUACAAGACCAAGAUUAAGCUUUGCAUUCU<br>UCUUCAUGCUUUCCGUAUUCGUCUGUGACUAUUGACCGUGUGAUGUCUUACUUAA<br>AUGCUUCUUGAUAAUAGGCUGGAGCCUCGGUGGCCAUGCUUCUUGCCCCUUGGGCC<br>UCCCCCCAGCCCCUCCUCCCCUUCCUGCACCCGUACCCCCCAAACACCAUUGUCAC<br>ACUCCAGUGGUCUUUGAAUAAAGUCUGAGUGGGCGGC |
| 346 | hIL12AB_015<br>(5'UTR ORF 3'UTR) | UCAAGCUUUUGGACCCUCGUACAGAAGCUAAUACGACUCACUAUAGGGAAAUAAGA<br>GAGAAAAGAAGAGUAAGAAGAAAUAUAAGAGCCACCAUGUGUCACCAGCAGCUGGU<br>GAUCAGCUGGUUUAGCCUGGUGUUUCUGGCCAGCCCCUGGUGGCCAUCUGGGAAC<br>UGAAGAAAGACGUGUACGUGGUAGAACUGGAUUGGUAUCCGGACGCUCCCGGCGAA<br>AUGGUGGUGCUGACCUGUGACACCCCCGAAGAAGACGGAAUCACCUGGACCCUGGA<br>CCAGAGCAGCGAGGUGCUGGGCAGCGGCAAAACCCUGACCAUCCAAGUGAAAGAGU<br>UUGGCGAUGCCGGCCAGUACACCUGCCACAAAGGCGGCGAGGUGCUAAGCCAUUCG<br>CUGCUGCUGCUGCACAAAAGGAAGAUGGCAUCGGAGCACCGAUACCUGAAGGA<br>CCAGAAAGAACCCAAAAAUAAGACCUUCUAAGAUGCGAGGCCAAGAAUUAUAGCG<br>GCCGUUUCACCUGCUGGUGGCUGACGACCAUCAGCACCGAUCUGACCUUCAGCGUG |

| SEQ ID NO | Description | Sequence |
|---|---|---|
| | | AAAAGCAGCAGAGGCAGCAGCGACCCCCAAGGCGUGACGUGCGGCGCCGCCACCCU
GAGCGCCGAGAGAGUGAGAGGCGACAACAAGGAGUAUGAGUACAGCGUGGAGUGCC
AGGAAGAUAGCGCCUGCCCCGCCGCCGAGGAGAGCCUGCCCAUCGAGGUGAUGGUG
GAUGCCGUGCACAAGCUGAAGUAUGAAAACUACACCAGCAGCUUCUUCAUCAGAGA
UAUCAUCAAACCCGACCCCCCCAAGAACCUGCAGCUGAAGCCCCUGAAGAAUAGCC
GGCAGGUGGAGGUGAGCUGGGAGUACCCCGACACCUGGAGCACCCCCCAUAGCUAC
UUCAGCCUGACCUUCUGCGUGCAGGUGCAGGGCAAGAGCAAGAGAGAAAAGAAAGA
UAGAGUGUUCACAGAUAAGACCAGCGCCACGGUGAUCUGCAGAAAAAAUGCCAGCA
UCAGCGUGAGAGCCCAAGAUAGAUACUAUAGCAGCAGCUGGAGCGAAUGGGCCAGC
GUGCCCUGCAGCGGCGGCGGCGGCGGCAGCAGAAACCUGCCCGUGGCCACCCC
CGACCCCGGCAUGUUCCCCUGCCUGCACCACAGCCAAAACCUGCUGAGAGCCGUGA
GCAACAUGCUGCAGAAGGCCCGGCAGACCCUGGAAUUUUACCCCUGCACCAGCGAA
GAGAUCGAUCAUGAAGAUAUCACCAAAGAUAAAACCAGCACCGUGGAGGCCUGUCU
GCCCCUGGAACUGACCAAGAAUGAGAGCUGCCUAAAUAGCAGAGAGACCAGCUUCA
UAACCAAUGGCAGCUGCCUGGCCAGCAGAAAGACCAGCUUUAUGAUGGCCCUGUGC
CUGAGCAGCAUCUAUGAAGACCUGAAGAUGUACCAGGUGGAGUUCAAGACCAUGAA
UGCCAAGCUGCUGAUGGAUCCCAAGCGGCAGAUCUUUCUGGAUCAAAACAUGCUGG
CCGUGAUCGAUGAGCUGAUGCAGGCCCUGAAUUUCAACAGCGAGACCGUGCCCCAA
AAAAGCAGCCUGGAAGAACCGGAUUUUUAUAAAACCAAAAUCAAGCUGUGCAUACU
GCUGCAUGCCUUCAGAAUCAGAGCCGUGACCAUCGAUAGAGUGAUGAGCUAUCUGA
AUGCCAGCUGAUAAUAGGCUGGAGCCUCGGUGGCCAUGCUUCUUGCCCCUUGGGCC
UCCCCCCAGCCCCUCCUCCCCUUCCUGCACCCGUACCCCCCAAACACCAUUGUCAC
ACUCCAGUGGUCUUUGAAUAAAGUCUGAGUGGGCGGC |
| 347 | hIL12AB_016 (5'UTR ORF 3'UTR) | UCAAGCUUUUGGACCCUCGUACAGAAGCUAAUACGACUCACUAUAGGGAAAUAAGA
GAGAAAAGAAGAGUAAGAAGAAAUAUAAGAGCCACCAUGUGCCACCAGCAGCUGGU
CAUCAGCUGGUUCAGCCUGGUCUUCCUGGCCAGCCCCCUGGUGGCCAUCUGGGAGC
UGAAGAAGGACGUAUACGUAGUGGAGUUGGAUUGGUACCCAGACGCUCCUGGGGAG
AUGGUGGUGCUGACCUGUGACACCCCAGAAGAGGACGGUAUCACCUGGACCCUGGA
CCAGAGCUCAGAAGUGCUGGGCAGUGGAAAAACCCUGACCAUCCAGGUGAAGGAGU
UUGGAGAUGCUGGCCAGUACACCUGCCACAAGGGUGGUGAAGUGCUGAGCCACAGC
CUGCUGCUGCUGCACAAGAAGGAGGAUGGCAUCUGGAGCACAGAUAUCCUGAAGGA
CCAGAAGGAGCCCAAGAACAAGACCUUCCUUCGCUGUGAAGCCAAGAACUACAGUG
GCCGCUUCACCUGCUGGUGGCUGACCACCAUCAGCACAGAUCUCACCUUCUCGGUG
AAGAGCAGCAGAGGCAGCUCAGACCCCAGGGUGUCACCUGUGGGGCGGCCACGCU
GUCGGCGGAGAGAGUUCGAGGUGACAACAAGGAGUAUGAAUACUCGGUGGAGUGCC
AGGAAGAUUCGGCGUGCCCGGCGGCAGAAGGAGAGCCUGCCCAUAGAAGUGAUGGU
GGAUGCUGUGCACAAGCUGAAGUAUGAAAACUACACCAGCAGCUUCUUCAUCAGAGA
UAUCAUCAAGCCAGACCCGCCCAAGAACCUGCAGCUGAAGCCCCUGAAGAACAGCC
GGCAGGUGGAGGUUUCCUGGGAGUACCCAGAUACGUGGAGCACCCCCCACAGCUAC
UUCAGCCUGACCUUCUGUGUCCAGGUGCAGGGCAAGAGCAAGAGAGAGAAGAAAGA
UAGAGUCUUCACAGAUAAGACCUCGGCCACGGUCAUCUGCAGAAAGAAUGCCUCCA
UCUCGGUUCGAGCCCAAGAUAGAUACUACAGCAGCAGCUGGUCAGAAUGGGCCUCG
GUGCCCUGCAGUGGUGGCGGCGGCGGCGGCAGCAGAAACCUGCCCUGUUGCCACCCC
AGACCCUGGGAUGUUCCCCUGCCUGCACCACAGCCGAACUUAUUACGAGCUGUUU
CUAACAUGCUGCAGAAGGCCCGGCAGACCCUGGAGUUCUACCCCUGCACCUCAGAA
GAGAUUGACCAUGAAGAUAUCACCAAAGAUAAGACCAGCACUGUAGAGGCCUGCCU
GCCCCUGGAGCUGACCAAGAAUGAAAGCUGCCUGAACAGCAGAGAGACCAGCUUCA
UCACCAAUGGAAGCUGCCUGGCCAGCAGAAAGACCAGCUUCAUGAUGGCCCUGUGC
CUGAGCAGCAUCUAUGAAGACCUGAAGAUGUACCAGGUGGAGUUCAAGACCAUGAA
UGCAAAGCUGCUGAUGGACCCCAAGCGGCAGAUAUUUUGGACCAGAACAUGCUGG
CUGUCAUUGAUGAGCUGAUGCAGGCCCUGAACUUCAACUCAGAAACUGUACCCCAG
AAGAGCAGCCUGGAGGAGCCAGAUUUCUACAAGACCAAGAUCAAGCUGUGCAUCCU
GCUUCAUGCUUUCAGAAUCAGAGCUGUCACCAUUGACCGCGUGAUGAGCUACUUAA
AUGCCUCGUGAUAAUAGGCUGGAGCCUCGGUGGCCAUGCUUCUUGCCCCUUGGGCC
UCCCCCCAGCCCCUCCUCCCCUUCCUGCACCCGUACCCCCCAAACACCAUUGUCAC
ACUCCAGUGGUCUUUGAAUAAAGUCUGAGUGGGCGGC |
| 348 | hIL12AB_017 (5'UTR ORF 3'UTR) | UCAAGCUUUUGGACCCUCGUACAGAAGCUAAUACGACUCACUAUAGGGAAAUAAGA
GAGAAAAGAAGAGUAAGAAGAAAUAUAAGAGCCACCAUGUGCCACCAGCAGCUGGU
AAUCAGCUGGUUUCCCUCGUCUUUCUGGCAUCACCCCUGGUGGCUAUCUGGGAGC
UGAAGAAGGACGUGUACGUGGUGGAGCUGGAUUGGUACCCUGACGCCCCCGGGGAA
AUGGUGGUGUUAACCUGCGACACGCCUGAGGAGGACGGCAUCACCUGGACGCUGGA
CCAGAGCAGCGAGGUGCUGGGUCUGGUAAAACUCUGACUAUUCAGGUGAAAGAGU
UCGGGGAUGCCGGCCAAUAUACUUGCCACAAGGGUGGCGAGGUGCUUUCUCAUUCU
CUGCUCCUGCUGCACAAGAAAGAUGGCAUUUGGUCUACUGAUAUUCUGAAAGA
CCAGAAGGAGCCCAAGAACAAGACCUUUCUGAGAUGCGAGGCUAAAAACUACAGCG
GAAGAUUUACCUGCUGGUGGCUGACCACAAUCUCAACCGACCUGACAUUUUCAGUG
AAGUCCAGCAGAGGGAGCUCCGACCCUCAGGGCGUGACCUGCGGAGCCGCCACUCU
GUCCGCAGAAAGAGUGAGAGGUGAUAAUAAGGAGUACGAGUAUUCAGUCGAGUGCC
AAGAAGAUUCGCCUGCCCAGCCGCCGAGGAGAGCCUGCCAAUCGAGGUGAUGGUA
GAUGCGGUACACAAGCUGAAGUAUGAGAACUACACAUCCUCCUUCUUCAUAAGAGA
UAUUAUCAAGCCUGACCCACCUAAAAAUCUGCAACUCAAGCCUUUGAAAAAUUCAC |

| SEQ ID NO | Description | Sequence |
|---|---|---|
| | | GGCAGGUGGAGGUGAGCUGGGAGUACCCUGAUACUUGGAGCACCCCCCAUAGCUAC<br>UUUUCGCUGACAUUCUGCGUCCAGGUGCAGGGCAAGUCAAAGAGAGAGAAGAAGGA<br>UCGCGUGUUCACUGAUAAAACAAGCGCCACAGUGAUCUGCAGAAAAAACGCUAGCA<br>UUAGCGUCAGAGCACAGGACCGGUAUUACUCCAGCUCCUGGAGCGAAUGGGCAUCU<br>GUGCCCUGCAGCGGUGGGGGCGGAGGCGGAUCCAGAAACCUCCCCGUUGCCACACC<br>UGAUCCUGGAAUGUUCCCCUGUCUGCACCACAGCCAGAACCUGCUGAGAGCAGUGU<br>CUAACAUGCUCCAGAAGGCCAGGCAGACCCUGGAGUUUUACCCCUGCACCAGCGAG<br>GAAAUCGAUCACGAAGAUAUCACCAAAGAUAAAACCUCCACCGUGGAGGCCUGCCU<br>GCCCCUGGAACUGACCAAAAACGAGAGCUGCCUGAAUAGCAGGGAGACCUCCUUCA<br>UCACCAACGGCUCAUGCCUUGCCAGCCGGAAAACUAGCUUCAUGAUGGCCCUGUGC<br>CUGUCUUCGAUCUAUGAGGACCUGAAAAUGUACCAGGUCGAAUUUAAGACGAUGAA<br>CGCAAAGCUGCUGAUGGACCCCAAGCGGCAGAUCUUUCUGGACCAGAACAUGCUGG<br>CAGUCAUGAUGAGUUGAUGCAGGCAUUAAACUUCAACAGCGAGACCGUGCCUCAG<br>AAGUCCAGCCUCGAGGAGCCAGAUUUUUAUAAGACCAAGAUCAAACUAUGCAUCCU<br>GCUGCAUGCUUUCAGGAUUAGAGCCGUCACCAUCGAUCGAGUCAUGUCUUACCUGA<br>AUGCUAGCUGAUAAUAGGCUGGAGCCUCGGUGGCCAUGCUUCUUGCCCCUUGGGCC<br>UCCCCCCAGCCCCUCCUCCCCUUCCUGCACCCGUACCCCCCAAACACCAUUGUCAC<br>ACUCCAGUGGUCUUUGAAUAAAGUCUGAGUGGGCGGC |
| 349 | hIL12AB_018<br>(5'UTR ORF<br>3'UTR) | UCAAGCUUUUGGACCCUCGUACAGAAGCUAAUACGACUCACUAUAGGGAAAUAAGA<br>GAGAAAAGAAGAGUAAGAAGAAAUAUAAGAGCCACCAUGUGUCACCAACAGUUAGU<br>AAUCUCCUGGUUUUCUCUGGUGUUUCUGGCCAGCCCCCUCGUGGCCAUCUGGGAGC<br>UUAAAAAGGACGUUUACGUGGUGGAGUUGGAUUGGUAUCCCGACGCUCCAGGCGAA<br>AUGGUCGUGCUGACCUGCGAUACCCCUGAAGAAGACGGUAUCACCUGGACGCUGGA<br>CCAGUCUUCCGAGGUGCUUGGAUCUGGCAAAACACUGACAAUACAAGUUAAGGAGU<br>UCGGGGACGCAGGGCAGUACACCUGCCACAAAGGCGGCGAGGUCCUGAGUCACUCC<br>CUGUUACUGCUCCACAAGAAAGAGGACGGCAUUUGGUCCACCGACAUUCUGAAGGA<br>CCAGAAGGAGCCUAAGAAUAAAACUUUCCUGAGAUGCGAGGCAAAAAACUAUAGCG<br>GCCGCUUUACUUGCUGGUGGCUUACAACAAUCUCUACCGAUUUAACUUUCUCCGUG<br>AAGUCUAGCAGAGGAUCCUCUGACCCGCAAGGAGUGACUUGCGGAGCCGCCACCUU<br>GAGCGCCGAAAGAGUCCGUGGCGAUAACAAAGAAUACGAGUACUCCGUGGAGUGCC<br>AGGAAGAUUCCGCCUGCCCAGCUGCCGAGGAGUCCCUGCCCAUUGAAGUGAUGGUG<br>GAUGCCGUCCACAAGCUGAAGUACGAAAACUAUACCAGCAGCUUCUUCAUCCGGGA<br>UAUCAUUAAGCCCGACCCUCCUAAAAACCUGCAACUUAAGCCCCUAAAGAAUAGUC<br>GGCAGGUUGAGGUCAGCUGGGAAUAUCCUGACACAUGGAGCACCCCCACUCUUAU<br>UUCUCCCUGACCUUCUGCGUGCAGGUGCAGGGCAAGAGUAAACGGGAGAAAAAGA<br>UAGGGUCUUUUACCGAUAAAACCAGCGCUACGGUUAUCUGUCGGAAGAACGCUUCCA<br>UCUCCGUCCGCGCUCAGGAUCGUUACUACUCGUCCUCAUGGAGCGAGUGGGCCAGC<br>GUGCCCUGCAGCGGCGGCGGUGGAGGCGGAUCCAGAAAUCUGCCUGUUGCCACACC<br>AGACCCUGGCAUGUUCCCCUGUCUGCAUCAUAGCCAGAACCUGCUCAGAGCCGUGA<br>GCAACAUGCUCCAGAAGGCCAGGCAAACUUUGGAGUUCUACCCGUGUACAUCUGAG<br>GAAAUCGAUCACGAAGAUAUAACCAAAGAUAAAACCUCUACAGUAGAGGCUUGUUU<br>GCCCCUGGAGUUGACCAAAAACGAGAGUUGCCUGAACAGUCGCGAGACGAGCUUCA<br>UUACUAACGGCAGCUGUCUCGCCUCCAGAAAAACAUCCUUCAUGAUGGCCCUGUGU<br>CUUUCCAGCAUAUACGAAGACCUGAAAAUGUACCAGGUCGAGUUCAAAACAAUGAA<br>CGCCAAGCUGCUUAUGGACCCCAAGCGGCAGAUCUUCCUCGACCAAAAACAUGCUCG<br>CUGUGAUCGAUGAGCUGAUGCAGGCUCUCAACUUCAAUUCCGAAACAGUGCCACAG<br>AAGUCCAGUCUGGAAGAACCCGACUUCUACAAGACCAAGAUUAAGCUGUGUAUUUU<br>GCUGCAUGCGUUUAGAAUCAGAGCCGUGACCAUUGAUCGGGUGAUGAGCUACCUGA<br>ACGCCUCGUGAUAAUAGGCUGGAGCCUCGGUGGCCAUGCUUCUUGCCCCUUGGGCC<br>UCCCCCAGCCCCUCCUCCCCUUCCUGCACCCGUACCCCCCAAACACCAUUGUCAC<br>ACUCCAGUGGUCUUUGAAUAAAGUCUGAGUGGGCGGC |
| 350 | hIL12AB_019<br>(5'UTR ORF<br>3'UTR) | UCAAGCUUUUGGACCCUCGUACAGAAGCUAAUACGACUCACUAUAGGGAAAUAAGA<br>GAGAAAAGAAGAGUAAGAAGAAAUAUAAGAGCCACCAUGUGUCACCAGCAGCUUGU<br>CAUCUCCUGGUUUUCUCUUGUCUUCCUGGCCUCGCCGCUGGUGGCCAUCUGGGAGC<br>UGAAGAAAGACGUUUACGUAGUAGAGUUGGAUUGGUACCCAGACGCACCUGGAGAA<br>AUGGUGGUUCUCACCUGUGACACUCCUGAAGAAGACGGUAUCACCUGGACGCUGGA<br>CCAAAGCUCAGAAGUUCUUGGCAGUGGAAAAACGCUGACCAUACAAGUAAAAGAAU<br>UUGGGGAUGCUGGCCAGUACACGUGCCACAAAGGAGGAGAAGUUCUCAGCCACAGU<br>UUACUUCUUCUUCACAAGAAAGAAGAUGGCAUCUGGUCCACAGAUAUUUUAAAAGA<br>CCAGAAGGAGCCCAAGAACAAAACCUUCCUCCGCUGUGAGGCCAAGAACUACAGUG<br>GUCGUUUCACCUGCUGGUGGCUCACCACCAUCUCCACUGACCUCACCUUCUCUGUA<br>AAAAGCAGCCGUGGUUCUUCUGACCCCCAAGGAGUCACCUGUGGGGCUGCCACGCU<br>CUCGGCAGAAAGAGUUCGAGGUGACAACAAGGAAUAUGAAUAUUCUGUGGAAUGUC<br>AAGAAGAUUCUGCCUGCCCGGCGGCAGAAGAAAGUCUUCCCAUAGAAGUCAUGGUU<br>GAUGCUGUUCACAAAUUAAAAUAUGAAAACUACACCAGCAGCUUCUUCAUUCGUGA<br>CAUCAUCAAACCAGACCCGCCCAAGAACCUUCAGUUAAAACCUUUAAAAAACAGCC<br>GGCAGGUAGAAGUUUCCUGGGAGUACCCAGAUACGUGGUCCACGCCGCACUCCUAC<br>UUCAGUUUAACCUUCUGUGUACAAGUACAAGGAAAUCAAAAGAGAAGAAGAAA<br>UCGUGUCUUCACUGACAAAACAUCUGCCACGGUCAUCUGCAGGAAGAAUGCCUCCA<br>UCUCGGUUCGAGCCCAGGACCGCUACUACAGCAGCAGCUGGAGUGAGUGGGCAUCU<br>GUUCCCUGCAGUGGUGGCGGCGGCGGCAGCCGCAACCUUCCUGUGGCCACGCC |

| SEQ ID NO | Description | Sequence |
|---|---|---|
| | | GGACCCUGGCAUGUUCCCGUGCCUUCACCACUCCCAAAAUCUUCUUCGUGCUGUUU<br>CUAACAUGCUGCAGAAGGCGCGCCAAACUUUAGAAUUCUACCCGUGCACUUCUGAA<br>GAAAUAGACCAUGAAGAUAUCACCAAAGAUAAAACCAGCACGGUGGAGGCCUGCCU<br>UCCUUUAGAGCUGACCAAGAAUGAAUCCUGCCUCAACAGCAGAGAGACCAGCUUCA<br>UCACCAAUGGCAGCUGCCUGGCCUCGCGCAAGACCAGCUUCAUGAUGGCGCUGUGC<br>CUUUCUUCCAUCUAUGAAGAUUUAAAGAUGUACCAAGUAGAAUUUAAAACCAUGAA<br>UGCCAAAUUAUUAAUGGACCCCAAACGGCAGAUAUUUUUGGAUCAAAACAUGCUGG<br>CUGUCAUUGAUGAGCUCAUGCAAGCAUUAAACUUCAACUCAGAAACUGUUCCCCAG<br>AAGUCAUCUUUAGAAGAGCCAGAUUUCUACAAAACAAAAAUAAAACUCUGCAUUCU<br>UCUUCAUGCCUUCCGCAUCCGUGCUGUCACCAUUGACCGUGUCAUGUCCUACUUAA<br>AUGCUUCUUGAUAAUAGGCUGGAGCUCGGUGGCCAUGCUUCUUGCCCCUUGGGCC<br>UCCCCCCAGCCCCUCCUCCCCUUCCUGCACCCGUACCCCCCAAACACCAUUGUCAC<br>ACUCCAGUGGUCUUUGAAUAAAGUCUGAGUGGGCGGC |
| 351 | hIL12AB_020<br>(5'UTR ORF<br>3'UTR) | UCAAGCUUUUGGACCCUCGUACAGAAGCUAAUACGACUCACUAUAGGGAAAUAAGA<br>GAGAAAAGAAGAGUAAGAAGAAAUAUAAGAGCCACCAUGUGCCACCAGCAGCUGGU<br>GAUCAGCUGGUUCAGCCUGGUGUUCCUGGCUAGCCCUCUGGUGGCCAUCUGGGAGC<br>UGAAGAAGGACGUGUACGUGGUGGAGUUGGAUUGGUACCCCGACGCUCCCGGCGAG<br>AUGGUGGUGCUGACCUGCGACACCCCCGAGGAGGACGGGAUCACCUGGACCCUGGA<br>UCAGUCAAGCGAGGUGCUGGGAAGCGGCAAGACCCUGACCAUCCAGGUGAAGGAGU<br>UCGGCGACGCCGGCCAAUACACUUGCCACAAGGGAGGCGAGGUGCUGUCCCACUCC<br>CUCCUGCUGCUGCACAAAAAGGAAGACGGCAUCUGGAGCACCGACAUCCUGAAAGA<br>CCAGAAGGAGCCUAAGAACAAAACAUUCCUCAGAUGCGAGGCCAAGAAUUACUCCG<br>GGAGAUUCACCUGUUGGUGGCUGACCACCAUCAGCACAGACCUGACCUUCAGCGUG<br>AAGAGCAGCAGAGGCAGCAGCGACCCCCAGGGCGUGACCUGUGGCGCCGCCACCCU<br>GAGCGCCGAAAGAGUGCGCGGCGACAACAAGGAGUACGAGUACUCCGUGGAAUGCC<br>AGGAAGAUAGCGCCUGCCCCGCCGCCGAGGAGAGCCUGCCCAUCGAGGUGAUGGUG<br>GACGCCGUCCACAAGCUGAAGUACGAGAACUACACCUCUAGCUUCUUCAUCAGAGA<br>UAUCAUCAAGCCCGAUCCCCCCAAGAACCUGCAGCUGAAACCCCUGAAGAACAGCC<br>GGCAGGUGGAGGUGAGCUGGGAGUAUCCCGACACCUGGUCCACCCCCCACAGCUAU<br>UUUAGCCUGACCUUCUGCGUGCAAGUGCAGGGCAAGAGCAAGAGAGAGAAGGAAGGA<br>CCGCGUGUUCACCGACAAAACCAGCGCCACCGUGAUCUGCAGAAAGAACGCCAGCA<br>UCAGCGUGAGGGCCCAGGAUAGAUACUACAGUUCCAGCUGGAGCGAGUGGGCCAGC<br>GUGCCCUGCAGCGGCGGCGGCGGGGGAGGCUCGAGAAACCUGCCCGUGGCUACCCC<br>CGAUCCCGGAAUGUUCCCCUGCCUGCACCACAGCCAGAACCUGCUGAGGGCGGUGU<br>CCAACAUGCUUCAGAAGGCCCGGCAGACCCUGGAGUUCUACCCCUGUACCUCUGAG<br>GAGAUCGAUCAUGAAGAUAUCACAAAAGAUAAAACCAGCACCGUGGAGGCCUGCCU<br>GCCCCUGGAGCUGACCAAGAACGAGAGCUGCCUGAACUCCCGCGAGACCAGCUUCA<br>UCACGAACGGCAGCUGCCUGGCCAGCAGGAAGACCUCCUUCAUGAUGGCCCUGUGC<br>CUGAGCAGCAUCUACGAGGACCUGAAAAUGUACCAGGUGGAGUUUAAGACCAUGAA<br>CGCCAAGCUGCUGAUGGACCCCAAGCGGCAAAUCUUCCUGGACCAGAACAUGCUGG<br>CAGUGAUCGACGAGCUCAUGCAGGCCCUGAACUUCAAUAGCGAGACGGUCCCCCAG<br>AAGAGCAGCCUGGAGGAGCCCGACUUUUACAAGACCAAGAUCAAGCUGUGCAUCCU<br>GCUGCACGCCUUUAGAAUCCGUGCCGUGACCAUUGACAGAGUGAUGAGCUACCUGA<br>AUGCCAGCUGAUAAUAGGCUGGAGCCUCGGUGGCCAUGCUUCUUGCCCCUUGGGCC<br>UCCCCCCAGCCCCUCCUCCCCUUCCUGCACCCGUACCCCCCAAACACCAUUGUCAC<br>ACUCCAGUGGUCUUUGAAUAAAGUCUGAGUGGGCGGC |
| 352 | hIL12AB_021<br>(5'UTR ORF<br>3'UTR) | UCAAGCUUUUGGACCCUCGUACAGAAGCUAAUACGACUCACUAUAGGGAAAUAAGA<br>GAGAAAAGAAGAGUAAGAAGAAAUAUAAGAGCCACCAUGUGCCACCAGCAGCUGGU<br>GAUCAGCUGGUUCAGCCUGGUGUUCCUGGCCAGCCCUCUGGUUGCCAUCUGGGAGC<br>UGAAGAAGACGUGUACGUCGUGGAACUGGACUGGUAUCCGGACGCCCCGGGCGAG<br>AUGGUGGUGCUGACCUGUGACACCCCCGAGGAGGACGGCAUCACCUGGACGCUGGA<br>CCAAUCCUCCGAGGUGCUGGGAAGCGGCAAGACCCUGACCAUCCAGGUGAAGGAAU<br>UCGGGGACGCCGGGCAGUACACCUGCCACAAGGGGGCGAAGUGCUGUCCCACUCG<br>CUGCUGCUCCUGCAUAAGAAGGAGGAUGGAAUCUGGUCCACCGACAUCCUCAAAGA<br>UCAGAAGGAGCCCAAGAACAAGACGUUCCUGCGCUGUGAAGCCAAGAAUUAUUCGG<br>GGCGAUUCACGUGCUGGUGGCUGACAACCAUCAGCACCGACCUGACGUUUAGCGUG<br>AAGAGCAGCAGGGGGUCCAGCGACCCCCAGGGCGUGACGUGCGGCGCCGCCACCCU<br>CUCCGCCGAGAGGGUGCGGGGGGACAAUAAGGAGUACGAGUACAGCGUGGAAUGCC<br>AGGAGGACAGCGCCUGCCCCGCCGCGGAGGAAAGCCUCCCGAUAGAGGUGAUGGUG<br>GACGCCGUGCACAAGCUCAAGUAUGAGAAUUACACCAGCAGCUUUUUCAUCCGGGA<br>CAUUAUCAAGCCCGACCCCCCGAAGAACCUCCAGCUGAAGCCCCUGAAGAACAGCC<br>GGCAGGUGGAAGUCUCCUGGGAGUAUCCCGACACCUGGAGCACCCCGCACAGCUAC<br>UUCUCCCUGACCUUCUGUGUGCAGGUGCAGGGCAAGUCCAAGAGGGAAAAGAAGGA<br>CAGGGUUUUCACCGACAAGACCAGCGCGACCGUGAUCUGCCGGAAGAACGCCAGCA<br>UAAGCGUCCGCGCCCAAGAUAGGUACUACAGCAGCUCUGGAGCGAGUGGGCUAGC<br>GUGCCCUGCAGCGGGGCGGGGGUGGGGCUCCAGGAACCUGCCAGAGUGGCGACCCC<br>CGACCCCGGCAUGUUCCCCUGCCUCCAUCACAGCCAGAACCUGCUGAGGGCCGUCA<br>GCAAUAUGCUGCAGAAGGCCAGGCAGACCCUGGAAUUCUACCCCUGCACGUCGGAG<br>GAGAUCGAUCACGAGGAUAUCACAAAAGACAAGACUUCCACCGUGGAGGCCUGCCU<br>GCCCCUGGAGCUCACCAAGAAUGAGUCCUGCUGAACUCCCGGGAAACCAGCUUCA<br>UCACCAACGGGUCCUGCCUGGCCAGCAGGAAGACCAGCUUUAUGAUGGCCCUGUGC |

SUMMARY OF SEQUENCES

| SEQ ID NO | Description | Sequence |
|---|---|---|
| | | CUGUCGAGCAUCUACGAGGACCUGAAGAUGUACCAGGUCGAGUUCAAGACAAUGAA<br>CGCCAAGCUGCUGAUGGACCCCAAGAGGCAAAUCUUCCUGGACCAGAAUAUGCUUG<br>CCGUCAUCGACGAGCUCAUGCAGGCCCUGAACUUCAACUCCGAGACCGUGCCCCAG<br>AAGAGCAGCCUGGAGGAGCCCGACUUCUACAAGACCAAGAUCAAGCUGUGCAUCCU<br>GCUGCACGCGUUCAGGAUCCGGGCAGUCACCAUCGACCGUGUGAUGUCCUACCUGA<br>ACGCCAGCUGAUAAUAGGCUGGAGCCUCGGUGGCCAUGCUUCUUGCCCCUUGGGCC<br>UCCCCCCAGCCCCUCCUCCCCUUCCUGCACCCGUACCCCCCAAACACCAUUGUCAC<br>ACUCCAGUGGUCUUUGAAUAAAGUCUGAGUGGGCGGC |
| 353 | hIL12AB_022<br>(5'UTR ORF<br>3'UTR) | UCAAGCUUUUGGACCCUCGUACAGAAGCUAAUACGACUCACUAUAGGGAAAUAAGA<br>GAGAAAAGAAGAGUAAGAAGAAAUAUAAGAGCCACCAUGUGCCAUCAGCAGCUGGU<br>GAUCAGCUGGUUCAGCCUGGUGUUCCUCGCUCUCCCCUGGUGGCCAUCUGGGAGC<br>UCAAAAGGACGUGUACGUGGUGGAGCUCGACUGGUACCCAGACGCCCCCGGGGAG<br>AUGGUGGUGCUGACCUGCGACACCCCCGAAGAAGACGGCAUCACGUGGACCCUCGA<br>CCAGUCCAGCGAGGUGCUGGGGGAGCGGGAAGACUCUGACCAUCCAGGUCAAGGAGU<br>UCGGGGACGCCGGGCAGUACACGUGCCACAAGGGCGGCGAAGUCUUAAGCCACAGC<br>CUGCUCCUGCUGCACAAGAAGGAGGACGGGAUCUGGUCCACAGACAUACUGAAGGA<br>CCAGAAGGAGCCGAAGAAUAAAACCUUUCUGAGGUGCGAGGCCAAGAACUAUUCCG<br>GCAGGUUCACGUGCUGGUGGCUUACAACAAUCAGCACAGACCUGACGUUCAGCGUG<br>AAGUCCAGCCGCGGCAGCAGCGACCCCCAGGGGGUGACCUGCGGCGCCGCCACCCU<br>GAGCGCCGAGCGGGUGCGCGGGGACAACAAGGAGUACGAGUACUCCGUGGAGUGCC<br>AGGAAGACAGCGCCUGUCCCGCCGCCGAAGAGCCUGCCUAUCGAGGUCAUGGUA<br>GAUGCAGUGCAUAAGCUGAAGUACGAGAACUAUACGAGCAGCUUUUUCAUACGCGA<br>CAUCAUCAAGCCCGACCCCCCCAAGAACCUGCAGCUUUAAGCCCCUGAAGAAUAGCC<br>GGCAGGUGGAGGUCUCCUGGGAGUACCCCGACACCUGGUCAACGCCCCACAGCUAC<br>UUCUCCCUGACCUUUUGUGUCCAAGUCCAGGGAAAGAGCAAGAGGGAGAAGAAAGA<br>UCGGGUGUUCACCGACAAGACCUCCGCCACGGUGAUCUGCAGGAAGAACGCCAGCA<br>UCUCCGUGAGGGCGCAAGACAGGUACUACUCCAGCAGCUGGUCCGAAUGGCCAGC<br>GUGCCCUGCUCCGGCGGCGGGGGCGGCGGCAGCCGAAACCUACCCGUGGCCACGCC<br>GGAUCCCGGCAUGUUUCCUGCCUCGCACCACAGCCAGAACCUCCUGAGGGCCGUGU<br>CCAACAUGCUGCAGAAGGCCAGGCAGACUCUGGAGUUCUACCCCUGCACGAGCGAG<br>GAGAUCGAUCACGAGGACAUCACCAAGGAUAAGACCAGCACGUGGAGGCCUGCCU<br>UCCCCUGGAGCUGACCAAGAACGAGAGCUGUCUGAACUCCAGGGAGACCUCAUUCA<br>UCACCAACGGCUCCUGCCUGGCCAGCAGGAAAACCAGCUUCAUGAUGGCCUUGUGU<br>CUCAGCUCCAUCUACGAGGACCUGAAGAUGUAUCAGGUCGAGUUCAAGACAAUGAA<br>CGCCAAGCUGCUGAUGGACCCCAAAAGGCAGAUCUUCCUGGACCAGAACAUGCUGG<br>CCGUCAUCGACGAGCUGAUGCAGGCCCUGAACUUCAACAGCGAGACGUGCCCCAG<br>AAAAGCUCCCUGGAGGAGCCCGACUUCUACAAGACCAAGAUCAAGCUGUGCAUCCU<br>GCUGCACGCCUUCAGGAUCAGGGCAGUGACCAUCGACCGGGUGAUGUCAUACCUUA<br>ACGCCAGCUGAUAAUAGGCUGGAGCCUCGGUGGCCAUGCUUCUUGCCCCUUGGGCC<br>UCCCCCCAGCCCCUCCUCCCCUUCCUGCACCCGUACCCCCCAAACACCAUUGUCAC<br>ACUCCAGUGGUCUUUGAAUAAAGUCUGAGUGGGCGGC |
| 354 | hIL12AB_023<br>(5'UTR ORF<br>3'UTR) | UCAAGCUUUUGGACCCUCGUACAGAAGCUAAUACGACUCACUAUAGGGAAAUAAGA<br>GAGAAAAGAAGAGUAAGAAGAAAUAUAAGAGCCACCAUGUGCCAUCAGCAGCUGGU<br>GAUCUCCUGGUUCAGCCUGGUGUUUCUGGCCUCGCCCCUGGUCGCCAUCUGGGAGC<br>UGAAGAAAGACGUGUACGUCGUCGAACUGGACUGGUACCCCGACGCCCCCGGGGAG<br>AUGGUGGUGCUGACCUGCGACACGCCGGAGGAGGACGGCAUCACCUGGACCCUGGA<br>UCAAAGCAGCGAGGUGCUGGGCAGCGGCAAGACCCUGACCAUCCAAGUGAAGGAAU<br>UCGGCGAUGCCGGCCAGUACACCUGUCACAAAGGGGGCGAGGUGCUCAGCCACAGC<br>CUGCUGCUGCUGCACAAGAAGGAGGAUGGCAUCUGGAGCACCGAUAUCCUGAAGGA<br>CCAGAAAGAGCCCAAGAACAAGACGUUCCUGAGGUGCGAGGCCAAGAACUACAGCG<br>GUAGGUUCACGUGUUGGUGGCUGACCACCAUCAGCACCGACCUGACGUUCAGCGUG<br>AAGAGCUCCAGGGGCAGCUCCGACCCACAGGGGGUGACGUGCGGGGCCGCAACCCU<br>CAGCGCCGAAAGGGUGCGGGGGGACAACAAGGAGUACGAAUACUCCGUGGAGUGCC<br>AGGAAGAUUCGGCCUGCCCCGCCGCGGAGGAGCCUCCCCAUCGAGGUAAUGGUG<br>GACGCCGUGCAUAAGCUGAAGUACGAGAACUACACCAGCUCGUUCUUCAUCCGAGA<br>CAUCAUCAAACCCGACCCGCCCAAAAAUCUGCAGCUCAAGCCCCUGAAGAACUCCA<br>GGCAGGUGGAGGUGAGCUGGGAGUACCCCGACACCUGGUCCACCCCGCACAGCUAC<br>UUCUCCCUGACAUUCUGCGUGCAGGUGCAGGGCAAGAGCAAGCGGGAGAAGAAGGA<br>CAGGGUGUUCACCGACAAGACGAGCGCCACCGUGAUCUGCCGAAAGAACGCCAGCA<br>UCUCGGUGCGCGCCCAGGAUAGGUACUAUUCCAGCUCCUGGAGCGAGUGGGCCUCG<br>GUACCCUGCAGCGGCGGCGGGGGCGGCGGCAGUAGGAAUCUGCCCGUGGCUACCCC<br>GGACCCGGGCAUGUUCCCCUGCCUCCACCACAGCCAGAACCUGCUGAGGGCCGUGA<br>GCAACAUGCUGCAGAAGGCCAGACAGACGCUGGAGUUCUACCCCUGCACGAGCGAG<br>GAGAUCGACCACGAGGACAUCACCAAGGAUAAAACUUCCACCGUCGAGGCCUGCCU<br>GCCCUUGGAGCUGACCAAGAAUGAAUCCUGUCUGAACAGCAGGGAGACCUCGUUUA<br>UCACCAAUGGCAGCUGCCUCGCCUCCAGGAAGACCAGCUUCAUGAUGGCCCUCUGU<br>CUGAGCUCCAUCUAUGAGGACCUGAAGAUGUACCAGGUGGAGUUCAAGACCAUGAA<br>CGCGAAGCUGCUGAUGGACCCCAAGAGGCAGAUCUUCCUGGAUCAGAAUAUGCUGG<br>CGGUGAUCGACGAGCUCAUGCAGGCCCUCAAUUUCAAUAGCGAGACAGUGCCCCAG<br>AAGUCCUCCCUGGAGGAGCCCGACUUCUACAAGACCAAGAUCAAGCUGUGUAUCCU<br>GCUGCACGCCUUCCGGAUCCGGGCCGUCACCAUCGACCGGGUCAUGAGCUACCUCA |

| SUMMARY OF SEQUENCES | | |
|---|---|---|
| SEQ ID NO | Description | Sequence |
| | | AUGCCAGCUGAUAAUAGGCUGGAGCCUCGGUGGCCAUGCUUCUUGCCCCUUGGGCC UCCCCCAGCCCCUCCUCCCCUUCCUGCACCCGUACCCCCCAAACACCAUUGUCAC ACUCCAGUGGUCUUUGAAUAAAGUCUGAGUGGGCGGC |
| 355 | hIL12AB_024 (5'UTR ORF 3'UTR) | UCAAGCUUUUGGACCCUCGUACAGAAGCUAAUACGACUCACUAUAGGGAAAUAAGA GAGAAAAGAAGAGUAAGAAGAAAUAUAAGAGCCACCAUGUGCCACCAGCAGCUGGU GAUCUCCUGGUUCUCCCUGGUGUUCCUGGCCUCGCCCCUGGUGGCCAUCUGGGAGC UGAAGAAGGACGUGUACGUCGUGGAGCUCGACUGGUACCCCGACGCCCCUGGCGAG AUGGUGGUGCUGACCUGCGACACCCCAGAGGAGGAUGGCAUCACCUGGACCCUGGA UCAGUCCUCCGAGGUGCUGGGCUCCGGCAAGACGCUGACCAUCCAAGUGAAGGAGU UCGGUGACGCCGGACAGUAUACCUGCCAUAAGGGCGGCGAGGUCCUGUCCCACAGC CUCCUCCUCCUGCAUAAGAAGGAGGACGGCAUCUGGAGCACCGACAUCCUGAAGGA CCAGAAGGAGCCCAAGAACAAGACCUUUCUGAGGUGCGAGGCCAAGAACUACAGCG GCCGAUUCACCUGCUGGUGGCUCACCACCAUAUCCACCGACCUGACUUUCUCCGUC AAGUCCUCCCGGGGGUCCAGCGACCCCCAGGGAGUGACCUGCGGCGCCGCCACCCU CAGCGCCGAGCGGUGCGGGGGACAACAAGGAGUACGAAUACUCCGUCGAGUGCC AGGAGGACUCCGCCUGCCCGGCCGCCGAGGAGAGCCUGCCCAUCGAGGUGAUGGUC GACGCGGUGCACAAGCUGAAGUACGAGAACUACACCAGCAGUUUCUUCAUCAGGGA UAUCAUCAAGCCAGAUCCCCCGAAGAAUCUGCAACUGAAGCCGCUGAAAAACUCAC GACAGGUGGAGGUGAGCUGGGAGUACCCCGACACGUGGAGCACCCCACAUUCCUAC UUCAGCCUGACCUUCUGCGUGCAGGUCCAGGGCAAGAGCAAGCGGGAGAAGAAGGA CAGGGUGUUCACGGAUAAGACCAGUGCCACCGUGAUCUGCAGGAAGAACGCCUCUA UUAGCGUGAGGGCCCAGGAUCGGUAUUACUCCUCGAGCUGGAGCGAAUGGGCCUCC GUGCCCUGCAGUGGGGGGGUGGAGGCGGGAGCAGGAACCUGCCCGUAGCAACCCC CGACCCCGGGAUGUUCCCCUGUCUGCACCACUCGCAGAACCUGCUGCGCGCGGUGA GCAACAUGCUCCAAAAAGCCCGUCAGACCUUAGAGUUCUACCCCUGCACCAGCGAA GAAAUCGACCACGAAGACAUCACCAAGGACAAAACCAGCACCGUGGAGGCGUGCCU GCCGCUGGAGCUGACCAAGAACGAGAGCUGCCUCAACUCCAGGGAGACCAGCUUUA UCACCAACGGCUCGUGCCUAGCCAGCCGGAAAACCAGCUUCAUGAUGGCCCUGUGC CUGAGCUCCAUUUACGAGGACCUGAAGAUGUAUCAGGUGGAGUUCAAGACCAUGAA UGCCAAACUCCUGAUGGACCCCAAGAGGCAGAUCUUCCUGGACCAGAACAUGCUCG CGGUGAUCGAUGAGCUGAUGCAGGCCCUGAACUUUAAUAGCGAGACCGUGCCCCAG AAAAGCAGCCUGGAGGAGCCGGACUUCUACAAGACCAAAAUCAAGCUGUGCAUCCU GCUCCACGCCUUCCGCAUCCGGGCCGUGACCAUCGACAGGGUGAUGAGCUACCUGA ACGCCAGCUGAUAAUAGGCUGGAGCCUCGGUGGCCAUGCUUCUUGCCCCUUGGGCC UCCCCCAGCCCCUCCUCCCCUUCCUGCACCCGUACCCCCCAAACACCAUUGUCAC ACUCCAGUGGUCUUUGAAUAAAGUCUGAGUGGGCGGC |
| 356 | hIL12AB_025 (5'UTR ORF 3'UTR) | UCAAGCUUUUGGACCCUCGUACAGAAGCUAAUACGACUCACUAUAGGGAAAUAAGA GAGAAAAGAAGAGUAAGAAGAAAUAUAAGAGCCACCAUGUGCCAUCAGCAGCUGGU GAUUUCCUGGUUCUCCCUGGUGUUCCUGGCCAGCCCCCUCGUGGCGAUCUGGGAGC UAAAGAAGGACGUGUACGUGGUGGAGCUGGACUGGUACCCGGACGCACCCGGCGAG AUGGUCGUUCUGACCUGCGAUACGCCAGAGGAGGACGGCAUCACCUGGACCCUCGA UCAGAGCAGCGAGGUCCUGGGGAGCGGAAAGACCCUGACCAUCCAGGUCAAGGAGU UCGGCGACGCCGGCCAGUACACCUGCCACAAAGGUGGCGAGGUCCUGAGCCACUCG CUGCUGCUCCUGCAUAAGAAGGAGGACGGAAUCUGGAGCACAGACAUCCUGAAAGA CCAGAAGGAGCCCAAGAACAAGACCUUUCUGAGGUGCGAGGCCAAGAACUACAGCG GGCGCUUCACGUGCUGGUGGCUGACCACCAUCAGCACGGACCUCACCUUCUCCGUG AAGAGCAGCCGGGGAUCCAGCGAUCCCCAAGGCGUCACCUGCGGCGCGGCCACCCU GAGCGCGGAGAGGGUCAGGGGCGAUAAUAAGGAGUAUGAGUACAGCGUGGAGUGCC AGGAGGACAGCGCCUGCCCGGCCGCCGAGGAGUCCCUGCCAAUCGAAGUGAUGGUC GACGCCGUGCACAAGCUGAAGUACGAGAACUACACCAGCAGCUUCUUCAUCCGGGA UAUCAUCAAGCCCGAUCCCCCGAAGAACCUGCAGCUGAAGCCCCUCAAGAACAGCC GGCAGGUGGAGGUGAGUUGGGAGUACCCCGACACCUGGUCAACGCCCCACAGCUAC UUCUCCCUGACCUUCUGUGUGCAGGUGCAGGGAAAGAGCAAGAGGGAGAAGAAAGA CCGGGUCUUCACCGACAAGACCAGCGCCACGGUGAUCUGCAGGAAGAACGCAAGCA UCUCCGUGAGGGCCCAGGACAGGUACUACAGCUCCAGCUGGUCCGAAUGGGCCAGC GUGCCCUGUAGCGGCGGCGGGGCGGUGGCAGCCGCAACCUCCCAGUGGCCACCCC CGACCCCGGCAUGUUCCCCUGCCUGCACCACAGCCAGAAUCUGCUGAGGGCCGUGA GUAACAUGCUGCAGAAGGCAAGGCAAACCCUCGAAUUCUAUCCCUGCACCUCCGAG GAGAUCGACCACGAGGAUAUCACCAAGGACAAGACCAGCACCGUCGAGGCCUGUCU CCCCCUGGAGCUGACCAAGAAUGAGAGCUGCCUGAACAGCGGGGAGACCAGCUUCA UCACCAACGGGAGCUGCCUGGCCUCCAGGAAGACCUCGUUCAUGAUGGCGCUGUGC CUCUCAAGCAUAUACGAGGAUCUGAAGAUGUACCAGGUGGAGUUUAAGACGAUGAA CGCCAAGCUGCUGAUGGACCCGAAGAGGCAGAUCUUCCUGGACCAGAACAUGCUGG CCGUGAUAGACGAGCUCAUGCAGGCCCUGAACUUCAACUCCGAGACCGUGCCGCAG AAGUCAUCCCUCGAGGAGCCCGACUUCUAUAAGACCAAGAUCAAGCUGUGCAUCCU GCUCCACGCCUUCCGGAUAAGGGCCGUGACGAUCGACAGGGUGAUGAGCUACCUUA ACGCCAGCUGAUAAUAGGCUGGAGCCUCGGUGGCCAUGCUUCUUGCCCCUUGGGCC UCCCCCAGCCCCUCCUCCCCUUCCUGCACCCGUACCCCCCAAACACCAUUGUCAC ACUCCAGUGGUCUUUGAAUAAAGUCUGAGUGGGCGGC |

-continued

SUMMARY OF SEQUENCES

| SEQ ID NO | Description | Sequence |
|---|---|---|
| 357 | hIL12AB_026 (5'UTR ORF 3'UTR) | UCAAGCUUUUGGACCCUCGUACAGAAGCUAAUACGACUCACUAUAGGGAAAUAAGA GAGAAAAGAAGAGUAAGAAGAAAUAUAAGAGCCACCAUGUGCCACCAGCAGCUCGU GAUCAGCUGGUUCUCCCUGGUGUUUCUCGCCAGCCCCUGGUGGCCAUCUGGGAGC UGAAGAAGGACGUGUACGUGGUGGAGCUGGACUGGUACCCUGACGCCCCGGGGGAG AUGGUCGUGCUGACCUGCGACACCCCCGAAGAGGACGGUAUCACCUGGACCCUGGA CCAGUCCAGCGAGGUGCUGGGCAGCGGCAAGACCCUGACUAUUCAAGUCAAGGAGU UCGGGAGACGCCGGCCAGUACACCUGCCACAAGGGUGGAGAGGUGUUAUCACACAGC CUGCUGCUGCUGCACAAGAAGGAAGACGGGAUCUGGAGCACCGACAUCCUGAAGGA CCAGAAGGAGCCCAAAAACAAGACCUUCCUGCGGUGCGAGGCCAAGAACUAUUCGG GCCGCUUUACGUGCUGGUGGCUGACCACCAUCAGCACUGAUCUCACCUUCAGCGUG AAGUCCUCCCGGGGGUCGUCCGACCCCCAGGGGGUGACCUGCGGGGCCGCCACCCU GUCCGCCGAGAGAGUGAGGGGCGAUAAUAAGGAGUACGAGUACAGCGUUGAUGCC AGGAAGAUAGCGCCUGUCCCGCCGCCGAGGAGAGCCUGCCCAUCGAGGUGAUGGUG GACGCCGUCCACAAGCUGAAGUAUGAGAACUACACCUCAAGCUUCUUCAUCAGGGA CAUCAUCAAACCCGAUCCGCCCAAGAAUCUGCAGCUGAAGCCCCUGAAAAAUAGCA GGCAGGUGGAGGUGAGCUGGGAGUACCCCGACACCUGGUCCACCCCCCAUAGCUAU UUCUCCCUGACGUUCUGCGUGCAGGUGCAAGGGAAGAGCAAGCGGGAGAAGAAGGA CCGGGUGUUCACCGACAAGACCUCCGCCACCGUGAUCUGUAGGAAGAACGCGUCGA UCUCGGUCAGGGCCCAGGACAGGUAUUACAGCAGCAGCUGGAGCGAGUGGGCGAGC GUGCCCUGCUCGGGCGGCGGCGGCGGCGGGAGCAGAAAUCUGCCCGUGGCCACCCC AGACCCCGGAAUGUUCCCCUGCCUGCACCAUUCGCAGAACCUCCUGAGGGCCGUGA GCAACAUGCUGCAGAAGGCCCGCCAGACGCUGGAGUUCUACCCCCUGCACGAGCGAG GAGAUCGACCACGAAGACAUCACCAAGGACAAAACCAGCACCGUGGAGGCCUGCCU GCCCCUGGAGCUGACCAAAAACGAAUCCUGCUCAACAGCGGGAGACCAGCUUCA UCACCAACGGCAGCUGCCUGGCCAGCCGAAAGACCUCCUUCAUGAUGGCCCUCUGC CUGAGCAGCAUCUAUGAGGAUCUGAAGAUGUAUCAGGUGGAGUUCAAGACCAUGAA UGCCAAGCUGCUGAUGGACCCCAAGAGGCAGAUAUUCCUGGACCAGAAUAUGCUGG CCGUGAUCGACGAGCUGAUGCAGGCCCUGAACUUCAACAGCGAGACCGUCCCCCAG AAGUCCAGCCUGGAGGAGCCGGACUUUUACAAAACGAAGAUCAAGCUGUGCAUACU GCUGCACGCCUUCAGGAUCCGGGCCGUGACAAUCGACAGGGUGAUGUCCUACCUGA ACGCCAGCUGAUAAUAGGCUGGAGCCUCGGUGGCCAUGCUUCUUGCCCCUUGGGCC UCCCCCCAGCCCCUCCUCCCCUUCCUGCACCCGUACCCCCCAAACACCAUUGUCAC ACUCCAGUGGUCUUUGAAUAAAGUCUGAGUGGGCGGC |
| 358 | hIL12AB_027 (5'UTR ORF 3'UTR) | UCAAGCUUUUGGACCCUCGUACAGAAGCUAAUACGACUCACUAUAGGGAAAUAAGA GAGAAAAGAAGAGUAAGAAGAAAUAUAAGAGCCACCAUGUGUCACCAGCAGCUGGU GAUCAGCUGGUUCUCCCUGGUGUUUCUGGCCAGCCCCUGGUGGCCAUCUGGGAGC UCAAGAAGGACGUCUACGUCGUGGAGCUGGAUUGGUACCCCGACGCUCCCGGGGAG AUGGUGGUGCUGACCUGCGACACCCCCGAGGAGGACGGCAUCACCUGGACGCUGGA CCAGAGCUCAGAGGUGCUGGGAAGCGGAAAGACACUGACCAUCCAGGUGAAGGAGU UCGGGGAUGCCGGGCAGUAUACCUGCCACAAGGGCGGCGAAGUGCUGAGCCAUUCC CUGCUGCUGCUGCACAAGAAGGAGGACGGCAUAUGGUCCACCGACAUCCUGAAGGA UCAGAAGGAGCCGAAGAAUAAAACCUUCCUGAGGUGCGAGGCCAAGAAUUACAGCG GCCGAUUCACCUGCUGGUGGCUGACCACCAUCAGCACCGACCUGACCUUCAGUGUG AAGUCCUCACGGGGCAGCUCAGAUCCCCAGGGCGUGACCUGCGGGGCCGCGACACU CAGCGCCGAGCGGGUGAGGGGUGAUAACAAGGAGUACGAGUAUUCUGUGGAGUGCC AGGAAGACUCCGCCUGUCCCGCCGCCGAGGAGUCCCUGCCCAUCGAGGUGAUGGUG GACGCCGUGCAUAAACUGAAGUACGAGAACUACACCUCCAGCUUCUUCAUCCGGGA UAUAAUCAAGCCCGACCCUCCGAAAAACCUGCAGCUGAAGCCCUUAAAAACAGCC GGCAGGUGGAGGUGAGCUGGGAGUACCCCGACACCUGGAGCACCCCCCAUAGCUAU UUCAGCCUGACCUUCUGCGUGCAGGUGCAGGGGAAGUCCAAGCGCGAGAAAAAGGA CCGGGUGUUCACCGACAAGACGAGCGCCACCGUGAUCUGCCGGAAGAACGCCAGUA UAAGCGUAAGGGCCCAGGAUAGGUACUACAGCUCCAGCUGGUCGGAGUGGGCCUCC GUGCCCUGUUCCGGCGGCGGGGGGGGUGGCAGCAGGAACCUCCCCGUGGCCACGCC GGACCCCGGCAUGUUCCCGUGCCUGCACCACUCCCAAAACCUCCUGCGGGCCGUCA GCAACAUGCUGCAAAAGGCGCGGCAGACCCUGGAGUUUUACCCCUGUACCUCCGAA GAGAUCGACCACGAGGAUAUCACCAAGGAUAAGACCUCCACCGUGGAGGCCUGUCU CCCCCUGGAGCUGACCAAGAACGAGAGCUGUCUUAACAGCAGAGAGACCUCGUUCA UAACGAACGGCUCCUGCCUCGCUUCCAGGAAGACGUCGUUCAUGAUGGCGCUGUGC CUGUCCAGCAUCUACGAGGACCUGAAGAUGUAUCAGGUCGAGUUCAAAACCAUGAA CGCCAAGCUGCUGAUGGACCCCAAGAGGCAGAUCUUCCUGGACCAGAACAUGCUCG CCGUGAUCGACGAGCUGAUGCAGGCCCUGAACUUCAACAGCGAAAACCGUGCCCAG AAGUCAAGCCUGGAGGAGCCGGACUUCUAUAAGACCAAGAUCAAGCUGUGUAUCCU GCUACACGCUUUUCGUAUCCGGGCCGUGACCAUCGACAGGGUUAUGUCGUACUUGA ACGCCAGCUGAUAAUAGGCUGGAGCCUCGGUGGCCAUGCUUCUUGCCCCUUGGGCC UCCCCCCAGCCCCUCCUCCCCUUCCUGCACCCGUACCCCCCAAACACCAUUGUCAC ACUCCAGUGGUCUUUGAAUAAAGUCUGAGUGGGCGGC |
| 359 | hIL12AB_028 (5'UTR ORF 3'UTR) | UCAAGCUUUUGGACCCUCGUACAGAAGCUAAUACGACUCACUAUAGGGAAAUAAGA GAGAAAAGAAGAGUAAGAAGAAAUAUAAGAGCCACCAUGUGCCACCAACAGCUCGU GAUCAGCUGGUUCAGCCUGGUGUUCCUGGCCAGCCCCGCUGGUGGCCAUCUGGGAGC UGAAGAAGGACGUGUACGUGGUGGAGCUGGACUGGUACCCCGACGCCCCCGGCGAG AUGGUGGUCCUGACCUGCGACACGCCGGAAGAGGACGGCAUCACCUGGACCCUGGA |

| SEQ ID NO | Description | Sequence |
|---|---|---|
| | | UCAGUCCAGCGAGGUGCUGGGCUCCGGCAAGACCCUGACCAUUCAGGUGAAGGAGU UCGGCGACGCCGGUCAGUACACCUGCCACAAGGGCGGCGAGGUGCUGAGCCACAGC CUACUGCUCCUGCACAAAAAGGAGGAUGGAAUCUGGUCCACCGACAUCCUCAAGGA CCAGAAGGAGCCGAAGAACAAGACGUUCCUCCGGUGCGAGGCCAAGAACUACAGCG GCAGGUUUACCUGCUGGUGGCUGACCACCAUCAGCACCGACCUGACAUUUCCGUG AAGAGCAGCCGCGGCAGCAGCGAUCCCCAGGGCGUGACCUGCGGGGCGGCCACCCU GUCCGCCGAGCGUGUGAGGGGCGACAACAAGGAGUACGAGUACAGCGUGGAAUGCC AGGAGGACAGCGCCUGUCCCGCCGCCGAGGAGAGCCUGCCAAUCGAGGUCAUGGUG GACGCCGUGCACAAGCUGAAGUACGAGAACUACACGAGCAGCUUCUUCAUCAGGGA CAUCAUCAAACCGGACCCGCCCAAGAACCUGCAGCUGAAACCCUUGAAAAACAGCA GGCAGGUGGAAGUGUCUUGGGAGUACCCCGACACCUGGUCCACCCCCACAGCUAC UUUAGCCUGACCUUCUGUGUGCAGGUCCAGGGCAAGUCCAAGAGGGAGAAGAAGGA CAGGGUGUUCACCGACAAAACCAGCGCCACCGUGAUCUGCAGGAAGAACGCCUCCA UCAGCGUGCGGGCCCAGGACAGGUAUUACAGCUCGUCGUGGAGCGAGUGGGCCAGC GUGCCCUGCUCCGGGGAGGCGGCGGCGGAAGCCGGAAUCUGCCCGUGGCCACCCC CGAUCCCGGCAUGUUCCCGUGUCUGCACCACAGCCAGAACCUGCUGCGGGCCGUGA GCAACAUGCUGCAGAAGGCCCGCCAAACCCUGGAGUUCUACCCCUGUACAAGCGAG GAGAUCGACCAUGAGGACAUUACCAAGGACAAGACCAGCACCGUGGAGGCCUGCCU GCCCCUCGAGCUCACAAAGAACGAAUCCUGCCUGAAUAGCCGCGAGACCAGCUUUA UCACGAACGGGUCCUGCCUCGCCAGCCGGAAGACAAGCUUCAUGAUGGCCCUGUGC CUGAGCAGCAUCUACGAGGACCUGAAAAUGUACCAAGUGGAGUUCAAAACGAUGAA CGCCAAGCUGCUGAUGGACCCCAAGCGCCAGAUCUUCCUGGACCAGAACAUGCUGG CCGUCAUCGACGAGCUCAUGCAGGCCCUGAACUUCAACAGCGAGACCGUGCCCCAG AAGAGCAGCCUGGAGGAGCCCGACUUCUACAAGACGAAGAUCAAGCUCUGCAUCCU GCUGCACGCUUUCCGCAUCCGCGCGGUGACCAUCGACCGGGUGAUGAGCUACCUCA ACGCCAGUUGAUAAUAGGCUGGAGCCUCGGUGGCCAUGCUUCUUGCCCCUUGGGCC UCCCCCCAGCCCCUCCUCCCCUUCCUGCACCCGUACCCCCCAAACACCAUUGUCAC ACUCCAGUGGUCUUUGAAUAAAGUCUGAGUGGGCGGC |
| 360 | hIL12AB_029 (5'UTR ORF 3'UTR) | UCAAGCUUUUGGACCCUCGUACAGAAGCUAAUACGACUCACUAUAGGGAAAUAAGA GAGAAAAGAAGAGUAAGAAGAAAUAUAAGAGCCACCAUGUGCCACCAACAGCUGGU GAUCAGCUGGUUCAGCCUGGUGUUUCUGGCCUCCCCUCUGGUGGCCAUCUGGGAGC UGAAGAAGGACGUGUACGUGGUGGAGCUGGACUGGUACCCUGACGCCCCCGGCGAA AUGGUGGUGCUGACGUGCGACACCCCCGAGGAGGAUGGCAUCACCUGGACCCUGGA CCAAAGCAGCGAGGUCCUCGGAAGCGGCAAGACCCUACACUAUCCAAGUGAAGGAGU UCGGGGAUGCGGGCCAGUACACCUGCCACAAGGGCGGCGAGGUGCUGUCUCAUAGC CUGCUGCUCCUGCAUAAGAAGGAAGACGGCAUCUGGAGCACCGACAUACUGAAGGA UCAGAAGGAGCCCAAGAACAAGACCUUCCUGAGGUGCGAGGCCAAGAACUACUCCG GCGCUUCACCUGUUGGUGGCUGACCACCAUCUCCACCGACCUGACCUUCAGCGUG AAGAGCAGCAGGGGGAGCAGCGACCCCCAGGGGGUGACCUGCGGAGCCGCGACCUU GUCCGCCGAGCGGUGAGGGGCGACAAUAAGGAGUACGAGUACUCGGUCGAAUGCC AGGAGGACUCCGCCUGCCCCGCCGCCGAGGAGUCCCUCCCCAUCGAAGUGAUGGUG GACGCCGUCCACAAGCUGAAGUACGAGAACUACACCAGCAGCUUCUUCAUACGGGA UAUCAUCAAGCCCGACCCCCCGAAGAACCUGCAGCUGAAACCCUUGAAGAACUCCA GGCAGGUGGAGGUGAGCUGGGAGUACCCCGACACCUGGUCCACCCCGCACUCUAC UUCAGCCUGACCUUCUGUGUACAGGUCCAGGGCAAGAGCAAGAGGGAAAAGAAGGA UAGGGUGUUCACCGACAAGACCUCCGCCACGGUGAUCUGUCGGAAAAACGCCAGCA UCUCCGUGCGGGCCCAGGACAGGUACUAUUCCAGCAGCUGGAGCGAGUGGGCCUCC GUCCCCUGCUCCGGCGGCGGUGGCGGGGGCAGCAGGAACCUCCCCGUGGCCACCCC CGAUCCCGGGAUGUUCCCAUGCCUGCACCACAGCCAAAACCUGCUGAGGGCCGUCU CCAAUAUGCUGCAGAAGGCGAGGCAGACCCUGGAGUUCUACCCCUGUACCUCCGAG GAGAUCGACCACGAGGAUAUCACCAAGGACAAGACCUCCACGGUCGAGGCGUGCCU GCCCCUGGAGCUCACGAAGAACGAGAGCUGCCUUAACUCCAGGGAAACCUCGUUUA UCACGAACGGCAGCUGCCUGGCGUCACGGAAGACCUCCUUUAUGAUGGCCCUAUGU CUGUCCUCGAUCUACGAGGACCUGAAGAUGUACCAGGUGGAGUUCAAGACCAUGAA CGCCAAGCUGCUGAUGGAUCCCAAGAGGCAGAUUUUCCUGGACCAGAACAUGCUGG CCGUGAUUGACGAGCUGAUGCAGGCGCUGAACUUCAACAGCGAGACAGUGCCGCAG AAGAGCUCCCUGGAGGAGCCGGACUUUUACAAGACCAAGAUAAAGCUGUGCAUCCU GCUCCACGCCUUCAGAAUACGGGCCGUCACCAUCGAUAGGGUGAUGUCUUACCUGA ACGCCUCCUGAUAAUAGGCUGGAGCCUCGGUGGCCAUGCUUCUUGCCCCUUGGGCC UCCCCCCAGCCCCUCCUCCCCUUCCUGCACCCGUACCCCCCAAACACCAUUGUCAC ACUCCAGUGGUCUUUGAAUAAAGUCUGAGUGGGCGGC |
| 361 | hIL12AB_030 (5'UTR ORF 3'UTR) | UCAAGCUUUUGGACCCUCGUACAGAAGCUAAUACGACUCACUAUAGGGAAAUAAGA GAGAAAAGAAGAGUAAGAAGAAAUAUAAGAGCCACCAUGUGCCACCAGCAGCUGGU GAUUAGCUGGUUUAGCCUGGUGUUUCCUGGCAAGCCCCCUGGUGGCCAUCUGGGAAC UGAAAAAGGACGUGUACGUGGUCGAGCUGGAUUGGUACCCCGACGCCCCCGGCGAA AUGGUGGUGCUGACGUGUGAUACCCCCGAGGAGGACGGGAUCACCUGGACCCUGGA UCAGAGCAGCGAGGUGCUGGGGAGCGGGAAGACCCUGACGAUCCAGGUCAAGGAGU UCGGCGACGCUGGGCAGUACACCUGCACAAGGGCGGGGAGGUGCUGUCCCACUCC CUGCUGCUCCUGCAUAAGAAAGAGGACGGCAUCUGGUCCACCGACAUCCUCAAGGA CCAGAAGGAGCCCAAGAACAAGACCUUCCUGCGGUGUGAGGCGAAGAACUACAGCG GCCGUUUCACCUGCUGGUGGCUGACGACAAUCAGCACCGACUUGACGUUCUCCGUG |

| SEQ ID NO | Description | Sequence |
|---|---|---|
| | | AAGUCCUCCAGAGGCAGCUCCGACCCCCAAGGGGUGACGUGCGGCGCGGCCACCCU GAGCGCCGAGCGGGUGCGGGGGGACAACAAGGAGUACGAGUACUCCGUGGAGUGCC AGGAGGACAGCGCCUGUCCCGCAGCCGAGGAGUCCCUGCCCAUCGAAGUCAUGGUG GACGCCGUCCACAAGCUGAAGUACGAGAACUACACCAGCAGCUUCUUCAUCCGCGA UAUCAUCAAGCCCGAUCCCCCCAAAAACCUGCAACUGAAGCCGCUGAAGAAUAGCA GGCAGGUGGAGGUGUCCUGGGAGUACCCGGACACCUGGAGCACGCCCCACAGCUAU UUCAGCCUGACCUUUUGCGUGCAGGUCCAGGGGAAGAGCAAGCGGGAGAAGAAGGA CCGCGUGUUUACGGACAAAACCAGCGCCACCGUGAUCUGCAGGAAGAACGCCAGCA UCAGCGUGAGGGCCCAGGACAGGUACUACAGCAGCUCCUGGAGCGAGUGGGCCUCC GUGCCCUGUUCCGGAGGCGGCGGGGGCGGUUCCCGGAACCUCCCGGUGGCCACCCC CGACCCGGGCAUGUUCCCGUGCCUGCACCACUCACAGAAUCUGCUGAGGGCCGUGA GCAAUAUGCUGCAGAAGGCAAGGCAGACCCUGGAGUUUUAUCCCUGCACCAGCGAG GAGAUCGACCACGAAGACAUCACCAAGGACAAGACCAGCACAGUGGAGGCCUGCCU GCCCCUGGAACUGACCAAGAACGAGUCCUGUCUGAACUCCCGGGAAACCAGCUUCA UAACCAACGGCUCCUGUCUCGCCAGCAGGAAGACCAGCUUCAUGAUGGCCCUGUGC CUCAGCUCCAUCUACGAGGACCUCAAGAUGUACCAGGUUGAGUUCAAGACCAUGAA CGCCAAGCUCCUGAUGGACCCCAAGAGGCAGAUCUUCCUGGACCAGAAUAUGCUGG CCGUGAUCGAUGAGUUAAUGCAGGCGCUGAACUUCAACAGCGAGACGGUGCCCCAA AAGUCCUCGCUGGAGGAGCCCGACUUCUACAAGACCAAGAUCAAGCUGUGCAUCCU CCUGCACGCCUUCCGAAUCCGGGCCGUAACCAUCGACAGGGUGAUGAGCUAUCUCA ACGCCUCCUGAUAAUAGGCUGGAGCCUCGGUGGCCAUGCUUCUUGCCCCUUGGGCC UCCCCCCAGCCCUCCUCCCCUUCCUGCACCCGUACCCCCCAAACACCAUUGUCAC ACUCCAGUGGUCUUUGAAUAAAGUCUGAGUGGGCGGC |
| 362 | hIL12AB_031 (5'UTR ORF 3'UTR) | UCAAGCUUUUGGACCCUCGUACAGAAGCUAAUACGACUCACUAUAGGGAAAUAAGA GAGAAAAGAAGAGUAAGAAGAAAUAUAAGAGCCACCAUGUGCCACCAGCAGCUCGU GAUCAGCUGGUUCUCGCUUGUGUUCCUGGCCUCCCCCCUCGUCGCCAUCUGGGAGC UGAAGAAAGACGUGUACGUGGUGGAGCUGGACUGGUAUCCGGACGCCCCUGGGGAG AUGGUGGUGCUGACCUGCGACACCCCGGAAGAGGACGGCAUCACCUGGACGCUCGA CCAGUCGUCCGAAGUGCUGGGGUCGGGCAAGACCCUCACCAUCCAGGUGAAGGAGU UCGGAGACGCCGGCCAGUACACCUGUCAUAAGGGGGGGGAGGUGCUGAGCCACAGC CUCCUGCUCCUGCACAAAAAGGAGGACGGCAUCUGGAGCACCGAUAUCCUCAAGGA CCAGAAGGAGCCCAAGAACAAGACGUUCCUGAGGUGUGAGGCCAAGAACUACAGCG GGCGGUUCACGUGUUGGUGGCUCACCACCAUCUCCACCGACCUCACCUUCUCCGUG AAGUCAAGCAGGGGCAGCUCCGACCCCCAAGGCGUCACCUGCGGCGCCGCCACCCU GAGCGCCGAGAGGGUCAGGGGGGAUAACAAGGAAUACGAGUACAGUGUGGAGUGCC AAGAGGAUAGCGCCUGUCCCGCCGCCGAAGAGAGCCUGCCCAUCGAAGUGAUGGUG GACGCCGUGCACAAGCUGAAGUACGAGAACUACACCUCCAGCUUCUUCAUCAGGGA UAUCAUCAAGCCCGAUCCCCCCAAGAACCUGCAGCUGAAGCCCUGAAGAACAGCA GGCAGGUGGAGGUGAGCUGGGAGUAUCCCGACACGUGGAGCACCCCGCACAGCUAC UUCUCGCUGACUUUCUGCGUGCAGGUGCAAGGGAAGUCCAAGAGGGAGAAGAAGGA UAGGGUGUUCACCGACAAAACGAGCGCCACCGUGAUCUGCCGGAAGAAUGCCAGCA UCUCUGUGAGGGCCCAGGACAGGUACUAUUCCAGCUCCUGGUCGGAGUGGGCCAGC GUGCCCUGUAGCGGCGGGGGCGGGGGCGGCAGCAGGAACCUCCCGGUUGCCACCCC CGACCCCGGCAUGUUUCCGUGCCUGCACCACUCGCAAAACCUGCUGCGCGGUCU CCAACAUGCUGCAAAAAGCGCGCCAGACGCUGGAGUUCUACCCCUGCACCAGCGAG GAGAUCGAUCAUGAAGAUAUCACCAAAGACAAGACCUCGACCGUGGAGGCCUGCCU GCCCCUGGAGCUCACCAAGAACGAAAGCUGCCUGAACAGCAGGGAGACAAGCUUCA UCACCAACGGCAGCUGCCUGGCCUCCCGGAAGACCAGCUUCAUGAUGGCCCUGUGC CUGUCCAGCAUCUACGAGGAUCUGAAGAUGUACCAAGUGGAGUUUAAGACCAUGAA CGCCAAGCUGUUAAUGGACCCCAAAAGGCAGAUCUUCCUGGAUCAGAACAUGCUGG CCGUCAUCGACGAGCUGAUGCAAGCCCUGAACUUCAACAGCGAGACGGUGCCCCAG AAGAGCAGCCUCGAGGAGCCCGACUUCUAUAAGACCAAGAUAAAGCUGUGCAUUCU GCUGCACGCCUUCAGAAUCAGGGCCGUGACCAUCGAUAGGGUGAUGAGCUACCUGA ACGCCAGCUGAUAAUAGGCUGGAGCCUCGGUGGCCAUGCUUCUUGCCCCUUGGGCC UCCCCCCAGCCCUCCUCCCCUUCCUGCACCCGUACCCCCCAAACACCAUUGUCAC ACUCCAGUGGUCUUUGAAUAAAGUCUGAGUGGGCGGC |
| 363 | hIL12AB_032 (5'UTR ORF 3'UTR) | UCAAGCUUUUGGACCCUCGUACAGAAGCUAAUACGACUCACUAUAGGGAAAUAAGA GAGAAAAGAAGAGUAAGAAGAAAUAUAAGAGCCACCAUGUGUCACCAGCAGCUGGU GAUUUCCUGGUUCAGUCUGGUGUUUCUUGCCAGCCCCCUGGUGGCCAUCUGGGAGC UGAAGAAAGACGUAUACGUCGUGGAGCUGGACUGGUAUCCGACGCCUCCCGGCGAG AUGGUGGUCCUCACCUGCGACACCCCAGAGGAGGACGGCAUCACCUGGACCCUGGA CCAGAGCUCCGAGGUCCUGGGCAGCGGUAAGACCCUCACCAUCCAGGUGAAGGAGU UUGGUGAUGCCGGCAGUAUACCUGCCACAAGGGCGGCGAGGUGCUGUCCCACAGC CUCCUGUUACUGCAUAAGAAGGAGGAUGGCAUCUGGAGCACCGACAUCCUCAAGGA CCAGAAAGAGCCCAAGAACAAGACCUUUCUGCGGUGCGAGGCGAAAAAUUACUCCG GCCGGUUCACCUGCUGGUGGCUGACCACCAUCAGCACGGACCUGACGUUCUCCGUG AAGUCGAGCAGGGGGAGCUCCGAUCCCCAGGGCGUGACCUGCGGCGCGGCCACCCU GAGCGCCGAGCGCGUCCGCGGGGACAAUAAGGAAUACGAAUAUAGCGUGGAGUGCC AGGAGGACAGCGCCUGCCCCGCGCCGAGGAGAGCCUCCCGAUCGAGGUGAUGGUG GAUGCCGUCCACAAGCUCAAAUACGAAAACUACACCAGCAGCUUCUUCAUUAGGGA CAUCAUCAAGCCCGACCCCCCCAAAAACCUGCAGCUGAAGCCCCUGAAGAACAGCC |

SUMMARY OF SEQUENCES

| SEQ ID NO | Description | Sequence |
|---|---|---|
| | | GCCAGGUCGAGGUGUCAUGGGAGUACCCAGACACCUGGAGCACCCCCCACUCCUAC<br>UUCAGCCUGACCUUCUGCGUCCAGGUGCAGGGAAAGUCCAAACGGGAGAAGAAGGA<br>UAGGGUCUUUACCGAUAAGACGUCGGCCACCGUCAUCUGCAGGAAGAACGCCAGCA<br>UAAGCGUGCGGGCGCAGGAUCGGUACUACAGCUCGAGCUGGUCCGAAUGGGCCUCC<br>GUGCCCUGUAGCGGAGGGGUGGCGGGGGCAGCAGGAACCUGCCCGUGGCCACCCC<br>GGACCCGGGCAUGUUUCCCUGCCUGCAUCACAGUCAGAACCUGCUGAGGGCCGUGA<br>GCAACAUGCUCCAGAAGGCCCGCCAGACCCUGGAGUUUUACCCCUGCACCAGCGAA<br>GAGAUCGAUCACGAAGACAUCACCAAAGACAAGACCUCCACCGUGGAGGCCUGUCU<br>GCCCCUGGAGCUGACCAAGAACGAGAGCUGUCUGAACAGCAGGGAGACCUCCUUCA<br>UCACCAACGGCUCCUGCCUGGCAUCCCGGAAGACCAGCUUCAUGAUGGCCCUGUGU<br>CUGAGCUCUAUCUACGAGGACCUGAAGAUGUACCAGGUCGAGUUCAAGACCAUGAA<br>CGCCAAGCUGCUGAUGGACCCCAAGCGACAGAUAUUCCUGGACCAGAACAUGCUCG<br>CCGUGAUCGAUGAACUGAUGCAAGCCCUGAACUUCAAUAGCGAGACCGUGCCCCAG<br>AAAAAGCAGCCUGGAGGAGCCCGACUUCUACAAGACCAAGAUCAAACUGUGCAUACU<br>GCUGCACGCGUUCAGGAUCCGGGCCGUCACCAUCGACCGGGUGAUGUCCUAUCUGA<br>AUGCCAGCUGAUAAUAGGCUGGAGCCUCGGUGGCCAUGCUUCUUGCCCCUUGGGGC<br>UCCCCCCAGCCCCUCCUCCCCUUCCUGCACCCGUACCCCCCAAACACCAUUGUCAC<br>ACUCCAGUGGUCUUUGAAUAAAGUCUGAGUGGGCGGC |
| 364 | hIL12AB_033 (5'UTR ORF 3'UTR) | UCAAGCUUUUGGACCCUCGUACAGAAGCUAAUACGACUCACUAUAGGGAAAUAAGA<br>GAGAAAAGAAGAGUAAGAAGAAAUAUAAGAGCCACCAUGUGCCACCAGCAGCUCGU<br>GAUUAGCUGGUUUUCGCUGGUGUUCCUGGCCAGCCCUCUGUGGCCAUCUGGGAGC<br>UGAAAAAGACGUGUACGUGGUGGAGCUGGACUGGUACCCGGACGCCCCCGGCGAG<br>AUGGUGGUGCUGACGUGCGACACCCCGAAGAGGACGGCAUCACCUGGACCCUGGA<br>CCAGUCAUCCGAGGUCCUGGGCAGCGGCAAGACGCUCACCAUCCAGGUGAAGGAGU<br>UCGGCGACGCCGGCCAGUACACAUGCCAUAAGGGCGGGGAGGUGCUGAGCCACAGC<br>CUGCUCCUCCUGCACAAGAAGGAGGAUGGCAUCUGGUCUACAGACAUCCUGAAGGA<br>CCAGAAAGAGCCCAAGAACAAGACCUUCCUCCGGUGCGAGGCCAAGAACUACUCCG<br>GCGGUUUACUUGUUGGUGGCUGACCACCAUCAGCACCGACCUCACCUUCAGCGUG<br>AAGAGCUCCCGAGGGAGCUCCGACCCCAGGGGUCACCUGCGGCGCCGCCACCCU<br>GAGCGCCGAGCGGGUGAGGGGCGACAACAAGGAGUAUGAAUACAGCGUGGAAUGCC<br>AAGAGGACAGCGCCUGUCCCGCGGCCGAGGAAAGCCUGCCCAUCGAGGUGAUGGUG<br>GACGCCGUCCACAAACUCAAGUACGAGAACUACACCAGCAGUUUCUUCAUUCGCGA<br>CAUCAUCAAGCCGGACCCCCCCAAAAACCUGCAGCUCAAACCCCUGAAGAACAGCA<br>GGCAGGUGGAGGUCAGCUGGGAGUACCCGGACACCUGGAGCACCCCCCAUAGCUAC<br>UUCAGCCUGACCUUCUGCGUGCAGGUGCAGGGCAAGAGCAAACGCGAGAAGAAGGA<br>CCGGGUGUUUACCGACAAGACCAGCGCCACGGUGAUCUGCCGAAAGAAUGCAAGCA<br>UCUCCGUGAGGGCGCAGGACCGCUACUACUCUAGCAGCUGGAGCGAGUGGGCCAGC<br>GUGCCCUGCAGCGGUGGCGGCGGAGGCGGCAGCCGUAACCUCCCCGUGGCCACCCC<br>CGACCCCGGCAUGUUCCCGUGUCUGCACCACUCCCAGAACCUGCUGAGGGCCGUCA<br>GCAAUAUGCUGCAGAAGGCCCGGCAGACCCUGGAGUUCUACCCCUGCACCUCCGAG<br>GAGAUCGACCAUGAGGACAUUACCAAGGACAAGACGAGCACUGUGGAGGCCUGCCU<br>GCCCCUGGAGCUCACCAAAAACGAGAGCUGCCUGAAUAGCAGGGAGACGUCCUUCA<br>UCACCAACGGCAGCUGUCUGGCCAGCAGGAAGACCAGCUUCAUGAUGGCCCUGUGC<br>CUCUCCUCCAUAUAUGAGGAUCUGAAGAUGUACCAGGUGGAGUUCAAGACCAUGAA<br>CGCCAAGCUGCUGAUGGAUCCCAAGAGGCAGAUCUUCCUGGACCAGAAUAUGCUGG<br>CCGUGAUUGACGAGCUGAUGCAGGCCCUGAACUUUAAUAGCGAGACCGUCCCCCAG<br>AAGAGCAGCCUGGAGGAGCCCGACUUCUAUAAGACCAAGAUCAAGCUGUGCAUACU<br>GCUGCACGCGUUUAGGAUAAGGGCCGUCACCAUCGACAGGGUGAUGAGCUACCUGA<br>AUGCCAGCUGAUAAUAGGCUGGAGCCUCGGUGGCCAUGCUUCUUGCCCCUUGGGCC<br>UCCCCCCAGCCCCUCCUCCCCUUCCUGCACCCGUACCCCCCAAACACCAUUGUCAC<br>ACUCCAGUGGUCUUUGAAUAAAGUCUGAGUGGGCGGC |
| 365 | hIL12AB_034 (5'UTR ORF 3'UTR) | UCAAGCUUUUGGACCCUCGUACAGAAGCUAAUACGACUCACUAUAGGGAAAUAAGA<br>GAGAAAAGAAGAGUAAGAAGAAAUAUAAGAGCCACCAUGUGCCACCAACAGCUGGU<br>GAUCUCCUGGUUCAGCCUGGUGUUCCUCGCCAGCCCCCUGGUGGCCAUCUGGGAGC<br>UGAAGAAAGACGUGUACGUGGUGGAGCUGGACUGGUAUCCCGACGCCCCCGGCGAG<br>AUGGUCGUGCUGACCUGCGACACCCCGGAGGAGGACGGCAUCACCUGGACCCUGGA<br>UCAGUCCUCCGAGGUGCUGGGCAGCGGGAAGACCCUGACCAUCCAGGUGAAAGAGU<br>UCGGAGAUGCCGGCCAGUAUACCUGCCACAAGGGGGUGAGGUGCUGAGCCAUAGC<br>CUCUUGCUUCUGCACAAGAAGGAGGACGGCAUCUGGUCCACCGACAUCCUCAAGGA<br>CCAAAAGGAGCCCAAGAAUAAAACGUUCCUGAGGUGCGAAGCCAAGAACUAUUCCG<br>GACGGUUCACCUGCUGGUGGCUGACCACCAUCAGCACCGACCUCACCUUCUCCGUA<br>AAGUCAAGCAGGGGCAGCUCCGACCCCCAGGGCGUGACCUGCGGAGCCGCCACCCU<br>GAGCGCAGAGAGGGUGAGGGGCGACAACAAGGAGUACGAAUACUCCGUCGAGUGCC<br>AGGAGGACAGCGCCUGCCCCGCCGCCGAGGAAAGUCUGCCCAUCGAGGUGAUGGUG<br>GACGCCGUGCACAAGCUCAAAUACGAGAACUACACCAGCAGCUUCUUCAUCCGGGA<br>UAUCAUCAAGCCCGACCCUCCAAAGAAUCUGCAGCUGAAACCCCUUAAGAACAGCA<br>GGCAGGUGGAGGUCAGCUGGGAGUACCCGGACACCUGGAGCACGCCCCACUCCUAC<br>UUUAGCCUGACCUUUUGCGUGCAGGUGCAGGGGAAAAGCAAGCGGGAGAAGAAGGA<br>CAGGGUGUUCACCGAUAAGACCUCCGCUACCGUGAUCUGCAGGAAGAACGCCUCAA<br>UCAGCGUGAGGGCCCAGGAUCGGUACUACUCCAGCUCCUGGAGCGAGUGGGCCAGC<br>GUGCCCUGCUCUGGCGGUGGCGGCGGGGGCAGCCGGAACCUGCCGGUGGCCACUCC |

| SEQ ID NO | Description | Sequence |
|---|---|---|
| | | CGACCCGGGCAUGUUCCCGUGCCUCCACCAUUCCCAGAACCUGCUGCGGGCCGUGU<br>CCAAUAUGCUCCAGAAGGCAAGGCAGACCCUGGAGUUCUACCCCUGCACCAGCGAG<br>GAGAUCGAUCACGAGGACAUCACCAAAGACAAAACCAGCACGGUCGAGGCCUGCCU<br>GCCCCUGGAACUCACCAAGAACGAAAGCUGUCUCAACAGCCGCGAGACCAGCUUCA<br>UAACCAACGGUUCCUGUCUGGCCUCCCGCAAGACCAGCUUUAUGAUGGCCCUCUGU<br>CUGAGCUCCAUCUAUGAAGACCUGAAAAUGUACCAGGUGGAGUUCAAAACCAUGAA<br>CGCCAAGCUUCUGAUGGACCCCAAGAGGCAGAUCUUCCUGGAUCAGAACAUGCUGG<br>CCGUGAUCGACGAGCUGAUGCAGGCCCUGAACUUUAACUCCGAGACCGUGCCCCAG<br>AAAAGCAGCCUGGAAGAGCCCGAUUUCUACAAAACGAAGAUCAAGCUGUGCAUCCU<br>GCUGCACGCCUUCCGGAUCCGUGCGGUGACCAUCGAUAGGGUGAUGAGCUACCUGA<br>ACGCCAGCUGAUAAUAGGCUGGAGCCUCGGUGGCCAUGCUUCUUGCCCCUUGGGCC<br>UCCCCCCAGCCCCUCCUCCCCUUCCUGCACCCGUACCCCCCAAACACCAUUGUCAC<br>ACUCCAGUGGUCUUUGAAUAAAGUCUGAGUGGGCGGC |
| 366 | hIL12AB_035<br>(5'UTR ORF<br>3'UTR) | UCAAGCUUUUGGACCCUCGUACAGAAGCUAAUACGACUCACUAUAGGGAAAUAAGA<br>GAGAAAAGAAGAGUAAGAAGAAAUAUAAGAGCCACCAUGUGCCACCAACAGCUGGU<br>AAUCAGCUGGUUCAGCCUGGUUUUCCUCGCUCGCCCCUGGUGGCCAUCUGGGAGU<br>UAAAGAAGGACGUGUACGUGGUGGAGCUGGAUUGGUACCCCGACGCCCCGGGCGAG<br>AUGGUCGUGCUCACCUGCGAUACCCCCGAGGAGGACGGGAUCACCUGGACCCUGGA<br>CCAAUCCAGCGAGGUGCUGGGCAGCGGCAAGACCCUGACCAUACAGGUGAAGGAAU<br>UUGGGGACGCCGGGCAGUACACCUGCCACAAGGGCGGGAAGUGCUGUCCCACUCC<br>CUCCUGCUGCUGCAUAAGAAGGAGGACGGCAUCUGGAGCACCGACAUCCUGAAGGA<br>CCAAAAGGAGCCCAAGAACAAGACCUUCCUGAGGUGCGAGGCCAAAAACUAUUCCG<br>GCCGCUUUACCUGUUGGUGGCUGACCACCAUCUCCACCGAUCUGACCUUCAGCGUG<br>AAGUCGUCUAGGGGCUCCUCCGACCCCCAGGGCGUAACCUGCGGCGCCGCGACCCU<br>GAGCGCCGAGAGGGUGCGGGGCGAUAACAAAGAGUACGAGUACUCGGUGGAGUGCC<br>AGGAGGACAGCGCCUGUCCGGCGGCCGAGGAGAGCCUGCCCAUCGAGGUGAUGGUG<br>GACGCCGUCCACAAGCUGAAGUACGAGAACUACACCAGUUCGUUCUUCAUCAGGGA<br>CAUCAUCAAGCCGGACCCCCCCAAGAACCUCCAGCUGAAGCCCCUGAAGAACAGCA<br>GGCAGGUGGAAGUGUCCUGGGAGUAUCCCGACACCUGGAGCACCCCCCACAGCUAC<br>UUCAGCCUGACCUUUUGCGUGCAGGUGCAGGGCAAAAGCAAGAGGGAAAAGAAGGA<br>CCGGGUGUUCACCGAUAAGACGAGCGCCACCGUUAUCUGCAGGAAGAACGCCUCCA<br>UAAGCGUGAGGGCGCAGGACCGUUACUACAGCAGCAGCUGGAGUGAGUGGGCAAGC<br>GUGCCCUGUAGCGGCGGGGGCGGGGGCGGGUCCCGCAACUCCCCGUCGCCACCCC<br>CGACCCAGGCAUGUUUCCGUGCCUGCACCACAGCCAGAACCUGCUGCGGGCCGUUA<br>GCAACAUGCUGCAGAAGGCCAGGCAGACCCUCGAGUUCUAUCCCUGCACAUCUGAG<br>GAGAUCGACCACGAAGACAUCACUAAGGAUAAGACCUCCACCGUGGAGGCCUGUCU<br>GCCCCUCGAGCUGACCAAGAAUGAAUCCUGCCUGAACAGCCGAGAGACCAGCUUUA<br>UCACCAACGGCUCCUGCCUGGCCAGCAGGAAGACCUCCUUCAUGAUGGCCCUGUGC<br>CUCUCCAGCAUCUACGAGGAUCUGAAGAUGUACCAGGUAGAGUUCAAGACGAUGAA<br>CGCCAAGCUCCUGAUGGACCCCAAGAGGCAGAUAUUCCUGGACCAGAACAUGCUGG<br>CGGUGAUCGACGAGCUGAUGCAGGCCCUGAAUUUCAACAGCGAGACGGUGCCACAG<br>AAGUCCAGCCUGGAGGAGCCAGACUUCUACAAGACCAAGAUCAAACUGUGCAUCCU<br>CCUGCACGCGUUCAGGAUCCGCGCCGUCACCAUAGACAGGGUGAUGAGUUAUCUGA<br>ACGCCAGCUGAUAAUAGGCUGGAGCCUCGGUGGCCAUGCUUCUUGCCCCUUGGGCC<br>UCCCCCCAGCCCCUCCUCCCCUUCCUGCACCCGUACCCCCCAAACACCAUUGUCAC<br>ACUCCAGUGGUCUUUGAAUAAAGUCUGAGUGGGCGGC |
| 367 | hIL12AB_036<br>(5'UTR ORF<br>3'UTR) | UCAAGCUUUUGGACCCUCGUACAGAAGCUAAUACGACUCACUAUAGGGAAAUAAGA<br>GAGAAAAGAAGAGUAAGAAGAAAUAUAAGAGCCACCAUGUGCCAUCAGCAGCUGGU<br>AAUCAGCUGGUUUAGCCUGGUGUUCCUGGCCAGCCCACUGGUGGCCAUCUGGGAGC<br>UGAAGAAGGACGUGUACGUGGUGGAACUGGACUGGUACCCCGACGCCCCUGGCGAG<br>AUGGUGGUACUGACCUGUGACACCCCGGAAGACGGUAUCACCUGGACCCUGGA<br>UCAGAGCUCCGAGGUGCUGGGCUCCGGCAAGACACUGACCAUCCAAGUUAAGGAAU<br>UUGGGGACGCCGGCCAGUACACCUGCCACAAGGGGGCGAGGUGCUGUCCCACUCC<br>CUGCUGCUUCUGCAUAAGAAGGAGGAUGGCAUCUGGUCCACCGACAUCUGAAGGA<br>CCAGAAGGAGCCCAAGAAUAAGACCUUCCUGAGAUGCGAGGCCAAGAACUACUCGG<br>GAAGGUUCACCUGCUGGUGGCUGACCACCAUCAGCACCGACCUGACCUUCUCCGUG<br>AAGAGCUCCCGGGGCAGCUCCGACCCCCAGGGCGUAACCUGUGGGGCCGCUACCCU<br>GUCCGCCGAGAGGGUCCGGGGCGACAACAAGGAAUACGAGUACAGCGUGGAGUGCC<br>AGGAGGACUCCGCCUGCCCCGCCGCCGAGGAGUCGCUGCCCAUAGAGGUGAUGGUG<br>GACGCCGUGCACAAGCUCAAGUACGAGAAUUACACCAGCAGCUUCUUUAUCAGGGA<br>CAUAAUUAAGCCGGACCCCCCAAAGAAUCUGCAGCUGAAGCCCCUGAAGAAUAGCC<br>GGCAGGUGGAAGUGUCCUGGGAGUACCCCGACACCUGGAGCACCCCCCACUCCUAU<br>UUCUCACUGACAUUCUGCGUGCAGGUGCAAGGGAAAAGCAAGAGGGAGAAGAAGGA<br>UAGGGGUGUUCACCGACAAGACAAGCGCCACCGUGAUCUGCCGAAAAAAUGCCAGCA<br>UCAGCGUGAGGGCCCAGGAUCGGUAUUACAGCAGCUCCUGGAGCGAGUGGGCCAGC<br>GUGCCCUGUUCCGGCGGGGAGGGGCGGCUCCCGGAACCUGCCGUGGCCACCCC<br>CGACCCUGGCAUGUUCCCCUGCCUGCAUCACAGCCAGAACCUGCUCCGGGCCGUGU<br>CGAACAUGCUGCAGAAGGCCCGGCAGACCCUCGAGUUUACCCCUGCACCAGCGAA<br>GAGAUCGACCACGAAGACAUAACCAAGGACAAGACCAGCACGGUGGAGGCCUGCCU<br>GCCCCUGGAGCUUACCAAAAACGAGUCCUGCCUGAACAGCCGGGAAACCAGCUUCA<br>UAACGAACGGGAGCUGCCUGGCCUCCAGGAAGACCAGCUUCAUGAUGGCGCUGUGU |

SUMMARY OF SEQUENCES

| SEQ ID NO | Description | Sequence |
|---|---|---|
| | | CUGUCCAGCAUAUACGAGGAUCUGAAGAUGUAUCAGGUGGAAUUCAAAACUAUGAA<br>UGCCAAGCUCCUGAUGGACCCCAAGAGGCAGAUCUUCCUGGACCAGAACAUGCUAG<br>CCGUGAUCGACGAGCUGAUGCAGGCCCUCAACUUCAACUCGGAGACGGUGCCCCAG<br>AAGUCCAGCCUCGAGGAGCCCGACUUCUACAAGACCAAGAUCAAGCUGUGCAUACU<br>GCUGCAUGCCUUCAGGAUAAGGGCGGUGACUAUCGACAGGGUCAUGUCCUACCUGA<br>ACGCCAGCUGAUAAUAGGCUGGAGCCUCGGUGGCCAUGCUUCUUGCCCCUUGGGCC<br>UCCCCCCAGCCCCUCCUCCCCUUCCUGCACCCGUACCCCCCAAACACCAUUGUCAC<br>ACUCCAGUGGUCUUUGAAUAAAGUCUGAGUGGGCGGC |
| 368 | hIL12AB_037 (5'UTR ORF 3'UTR) | UCAAGCUUUUGGACCCUCGUACAGAAGCUAAUACGACUCACUAUAGGGAAAUAAGA<br>GAGAAAAGAAGAGUAAGAAGAAAUAUAAGAGCCACCAUGUGCCACCAACAACUGGU<br>GAUCAGCUGGUUCUCCCUGGUGUUCCUGGCCAGCCCCCUGGUGGCCAUCUGGGAGC<br>UCAAAAAGACGUGUACGUGGUGGAGCUCGAUUGGUACCCAGACGCGCCGGGGGAA<br>AUGGUGGUGCUGACCUGCGACACCCCAGAGGAGGAUGGCAUCACGUGGACCGCUGGA<br>UCAGUCCAGCGAGGUGCUGGGGAGCGGCAAGACGCUCACCAUCCAGGUGAAGGAAU<br>UUGGCGACGCGGGCCAGUAUACCUGUCACAAGGGCGGCGAGGUGCUGAGCCACUCC<br>CUGCUGCUGCUGCACAAGAAGGAGGAUGGGAUCUGGUCAACCGAUAUCCUGAAAGA<br>CCAGAAGGAGCCCAAGAACAAGACCUUCCUGCGCUGCGAGGCCAAGAACUAUAGCG<br>GCAGGUUCACCUGCUGGUGGCUGACCACCAUCAGCACCGACCUGACCUUCAGCGUG<br>AAAUCCUCCAGGGGCAGCAGCGACCCCCAGGGCGUGACCUGCGGUGCCGCCACGCU<br>CUCCGCCGAGCGAGUGAGGGGUGACAACAAGGAGUACGAGUACAGCGUGGAAUGUC<br>AGGAGGACAGCGCCUGUCCCGCCGCCGAGGAGUCGCUGCCCAUCGAGGUGAUGGUC<br>GACGCGGUGCACAAGCUCAAAUACGAGAAUUACACCAGCAGCUUCUUCAUCAGGGA<br>CAUCAUCAAGCCCGACCCCCCCAAGAACCUGCAGCUGAAGCCCUUGAAGAACAGCA<br>GGCAGGUGGAGGUGAGCUGGGAGUACCCGGACACCUGGAGCACCCCCCACUCCUAC<br>UUCAGCCUGACGUUCUGUGUGCAGGUGCAGGGGAAGUCCAAGAGGGAGAAGAAGGA<br>CCGGGUGUUCACCGACAAGACCAGCGCCACCGUGAUAUGCCGCAAGAACGCGUCCA<br>UCAGCGUUCGCGCCCAGGACCGCUACUACAGCAGCUCCUGGUCCGAAUGGGCCAGC<br>GUGCCCUGCAGCGGUGGAGGGGCGGGGGCUCCAGGAAUCUGCCGGUGGCCACCCC<br>CGACCCCGGGAUGUUCCCGUGUCUGCAUCACUCCCAGAACCUGCUGCGGGCCGUGA<br>GCAAUAUGCUGCAGAAGGCCAGGCAGACGCUCGAGUUCUACCCCUGCACCUCCGAA<br>GAGAUCGACCAUGAGGACAUCACCAAGGACAAGACCAGCACCGUGGAGGCCUGCCU<br>CCCCCUGGAGCUGACCAAAAACGAGAGCUGCCUGAACUCCAGGGAGACCAGCUUUA<br>UAACCAACGGCAGCUGCCUCGCCUCCAGGAAGACCUCGUUUAUGAUGGCCCUCUGC<br>CUGUCCAGCAUCUACGAGGACCUGAAGAUGUACCAGGUGGAGUUCAAGACCAUGAA<br>CGCGAAGUUGCUCAUGGACCCCAAGAGGCAGAUCUUCCUGGACCAGAACAUGCUCG<br>CGGUGAUCGACGAGCUGAUGCAAGCCCUGAACAGCGAGACCGUGCCCCAG<br>AAGAGCAGCCUGGAAGAGCCCGACUUCUACAAGACCAAGAUCAAGCUGUGCAUCCU<br>GCUGCACGCCUUCCGGAUCCGGGCCGUGACCAUCGACAGGGUGAUGAGCUACCUCA<br>ACGCCUCCUGAUAAUAGGCUGGAGCCUCGGUGGCCAUGCUUCUUGCCCCUUGGGCC<br>UCCCCCCAGCCCCUCCUCCCCUUCCUGCACCCGUACCCCCCAAACACCAUUGUCAC<br>ACUCCAGUGGUCUUUGAAUAAAGUCUGAGUGGGCGGC |
| 369 | hIL12AB_038 (5'UTR ORF 3'UTR) | UCAAGCUUUUGGACCCUCGUACAGAAGCUAAUACGACUCACUAUAGGGAAAUAAGA<br>GAGAAAAGAAGAGUAAGAAGAAAUAUAAGAGCCACCAUGUGCCACCAGCAGCUCGU<br>GAUCAGCUGGUUCUCCCUCGUCUUCCUGGCCUCCCCGCUGGUGGCCAUCUGGGAGC<br>UGAAGAAGGACGUGUACGUGGUGGAGCUGGACUGGUAUCCCGACGCCCCCGGCGAG<br>AUGGUGGUGCUGACGUGCGACACACCAGAAGAGGACGGGAUCACAUGGACCCUGGA<br>UCAGUCGUCCGAGGUGCUGGGGAGCGGCAAGACCCUCACCAUCCAAGUGAAGGAGU<br>UCGGGGACGCCGGCCAGUACACCUGCCACAAGGGCGGGGAGGUGCUCUCCCAUAGC<br>CUGCUCCUCCUGCACAAAAAGGAGGAUGGCAUCUGGAGCACCGACAUCCUGAAGGA<br>CCAGAAGGAGCCCAAGAACAAGACAUUUCUCAGGUGUGAGGCCAAGAACUAUUCGG<br>GCAGGUUUACCUGUUGGUGGCUCACCACCAUCUCUACCGACCUGACGUUCUCCGUC<br>AAGUCAAGCAGGGGGAGCUCGGACCCCCAGGGGGUGACAUGUGGGGCCGCCACCCU<br>GAGCGCGGAGCGUGUCCGCGGCGACAACAAGGAGUACGAGUAUUCCGUGGAGUGCC<br>AGGAGGACAGCGCCUGCCCCGCCGCCGAGGAGUCCCUGCCCAUAGAGGUGAUGGUG<br>GACGCCGUCCACAAGUUGAAGUACGAAAAUUAUACCUCCUCGUUCUUCAUUAGGGA<br>CAUCAUCAAGCCUGACCCCCGAAGAACCUACAACUCAAGCCCCUCAAGAACUCCC<br>GCCAGGUGGAGGUGUCCUGGGAGUACCCCGACACCUGGUCCACCCCGCACAGCUAC<br>UUCAGCCUGACCUUCUGCGUGCAGGUCCAGGGGAAGAGCAAGCUGAAAAGAAGA<br>CAGGGUGUUCACCGACAAGACGAGCGCCACCGUGAUCUGCAGGAAAAACGCCUCCA<br>UCUCCGUGCGCGCCCAGGACAGGUACUACAGUAGCUCCUGGAGCGAAUGGGCCAGC<br>GUGCCGUGCAGCGGCGGGGAGGAGCGGCAGUCGCAACCUGCCCGUGGCCACCCC<br>CGACCCCGGCAUGUUCCCGAUGCCUGCACCACAGCCAGAACCUGCUGAGGGCAGUCA<br>GCAAUAUGCUGCAGAAGGCCAGGCAGACCCUGGAGUUUUAUCCCUGCACCAGCGAG<br>GAGAUCGACCACGAGGACAUCACCAAGGACAAGACCUCCACCGUCGAGGCCUGCCU<br>GCCACUGGAGCUGACCAAAAACGAGAGCUGCCUGAACUCCAGGGAGACCUCCUUCA<br>UCACCAACGGGAGCUGCCUGGCCAGCCGGAAGACCAGCUUCAUGAUGGCGCUGUGC<br>CUCAGCAGCAUCUACGAGGAUCUCAAGAUGUACCAGGUGGAGUUCAAGACCAUGAA<br>CGCGAAGCUGCUGAUGGACCCCAAGCGGCAGAUCUUCCUGGACCAGAACAUGCUGG<br>CCGUGAUUGACGAGCUCAUGCAGGCCCUGAACUUCAAUAGCGAGACCGUCCCCCAA<br>AAGAGCAGCCUGGAGGAACCCGACUUCUACAAAACGAAGAUCAAGCUCUGCAUCCU<br>GCUGCACGCCUUCCGGAUCCGGGCCGUGACCAUCGAUCGUGUGAUGAGCUACCUGA |

| SEQ ID NO | Description | Sequence |
|---|---|---|
| | | ACGCCUCGUGAUAAUAGGCUGGAGCCUCGGUGGCCAUGCUUCUUGCCCCUUGGGCC UCCCCCCAGCCCCUCCUCCCCUUCCUGCACCCGUACCCCCCAAACACCAUUGUCAC ACUCCAGUGGUCUUUGAAUAAAGUCUGAGUGGGCGGC |
| 370 | hIL12AB_039 (5'UTR ORF 3'UTR) | UCAAGCUUUUGGACCCUCGUACAGAAGCUAAUACGACUCACUAUAGGGAAAUAAGA GAGAAAAGAAGAGUAAGAAGAAAUAUAAGAGCCACCAUGUGCCACCAGCAGCUCGU CAUCUCCUGGUUUAGCCUGGUGUUUCUGGCCUCCCCCUGGUCGCCAUCUGGGAGC UGAAGAAAGACGUGUACGUGGUGGAGCUGGACUGGUACCCGGACGCUCCCGGGGAG AUGGUGGUGCUGACCUGCGACACCCCCGAGGAGGACGGCAUCACCUGGACCCUGGA CCAGAGCUCCGAGGUGCUGGGGAGCGGCAAGACCCUGACCAUUCAGGUGAAAGAGU UCGGCGACGCCGGCCAAUAUACCUGCCACAAGGGGGGGGAGGUCCUGUCGCAUUCC CUGCUGCUGCUUCACAAAAAGGAGGAUGGCAUCUGGAGCACCGACAUCCUGAAGGA CCAGAAAGAACCCAAGAACAAGACGUUCCUGCGCUGCGAGGCCAAGAACUACAGCG GCCGGUUCACCUGUUGGUGGCUGACCACCAUCUCCACCGACCUGACUUUCUCGGUG AAGAGCAGCCGCGGGAGCAGCGACCCCCAGGGAGUGACCUGCGGCGCCGCCACCCU GAGCGCCGAAAGGGUGAGGGGCGACAAUAAAGAGUACGAGUAUUCCGUGGAGUGCC AGGAGGACAGCGCCUGUCCCGCCGCCGAGGAGUCCUGCCUAUCGAGGUGAUGGUC GACGCGGUGCACAAGCUCAAGUACGAAAACUACACCAGCAGCUUUUUCAUCAGGGA UAUCAUCAAACCAGACCCCCCCAAGAACCUGCAGCUGAAGCCCCUGAAAAACAGCA GGCAGGUGGAAGUGAGCUGGGAAUACCCCGAUACCUGGUCCACCCCCCACAGCUAC UUCAGCCUGACCUUCUGCGUGCAGGUGCAGGGGAAGUCCAAGCGGGAGAAGAAAGA UCGGGUGUUCACGGACAAGACCAGCGCCACCGUGAUUUGCAGGAAAAACGCCAGCA UCUCCGUGAGGGCUCAGGACAGGUACUACAGCUCCAGCUGGAGCGAGUGGGCCUCC GUGCCUUGCAGCGGGGGAGGAGGCGGCGGCAGCAGGAAUCUGCCCGUCGCAACCCC CGACCCCGGCAUGUUCCCCUGCCUGCACCACAGCCAGAAUCUGCUGCGAGCCGUGA GCAACAUGCUCCAGAAGGCCCGGCAGACGCUGGAGUUCUACCCCUGCACCUCCGAG GAGAUCGACCACGAGGACAUCACCAAGGAUAAGACGAGCACCGUCGAGGCCUGUCU CCCCCUGGAGCUCACCAAGAACGAGUCCUGCCUGAAUAGCAGGGAGACGUCCUUCA UAACCAACGGCAGCUGUCUGGCGUCCAGGAAGACCAGCUUCAUGAUGGCCCUCUGC CUGAGCUCCAUCUACGAGGACCUCAAGAUGUACCAGGUCGAGUUCAAGACCAUGAA CGCAAAACUGCUCAUGGAUCCAAAGAGGCAGAUCUUUCUGGACCAGAACAUGCUGG CCGUGAUCGAUGAACUCAUGCAGGCCCUGAAUUUCAAUUCCGAGACCGUGCCCCAG AAGAGCUCCCUGGAGGAACCCGACUUCUACAAAACAAAGAUCAAGCUGUGUAUCCU CCUGCACGCCUUCCGGAUCAGGGCCGUCACCAUUGACCGGGUGAUGUCCUACCUGA ACGCCAGCUGAUAAUAGGCUGGAGCCUCGGUGGCCAUGCUUCUUGCCCCUUGGGCC UCCCCCCAGCCCCUCCUCCCCUUCCUGCACCCGUACCCCCCAAACACCAUUGUCAC ACUCCAGUGGUCUUUGAAUAAAGUCUGAGUGGGCGGC |
| 371 | hIL12AB_040 (5'UTR ORF 3'UTR) | UCAAGCUUUUGGACCCUCGUACAGAAGCUAAUACGACUCACUAUAGGGAAAUAAGA GAGAAAAGAAGAGUAAGAAGAAAUAUAAGAGCCACCAUGUGCCAUCAGCAGCUGGU GAUCAGCUGGUUCAGCCUCGUGUUCCUCGCCAGCCCCUCGUGGCCAUCUGGGAGC UGAAAAGGACGUGUACGUGGUGGAGCUGGACUGGUAUCCCGACGCCCGGGCGAG AUGGUGGUGCUGACCUGCGACACCCCCGAGGAGGACGGCAUUACCUGGACACUGGA CCAGAGCAGCGAGGUCCUGGGCAGCGGGAAGACCCUGACAAUUCAGGUGAAGGAGU UCGGCGACGCCGGACAGUACACGUGCCACAAGGGGGGGGAGGUGCUGUCCCACAGC CUCCUCCUGCUGCACAAGAAGGAGGAUGGCAUCUGGAGCACCGACAUCCUGAAGGA UCAGAAGGAGCCCAAGAACAAGACCUUUCUGAGAUGCGAGGCCAAGAAUUACAGCG GCCGUUUCACCUGCUGGUGGCUCACCACCAUCAGCACCGACCUGACCUUCAGCGUG AAAUCCUCCAGGGGCUCCUCCGACCCGCAGGGAGUGACCUGCGGCGCCGCCACACU GAGCGCCGAGCGGGUCAGAGGGGACAACAAGGAGUACAGCAGCGUUGAGUGCC AGGAGGACAGCGCCUGUCCCGCGGCCGAGGAAUCCCUGCCCAUCGAGGUGAUGGUG GACGCAGUGCACAAGCUGAAGUACGAGAACUAUACCUCGAGCUUCUUCAUCCGGGA UAUCAUUAAGCCCGAUCCCCCGAAGAACCUGCAGCUCAAACCCCUGAAGAACAGCA GGCAGGUGGAGGUCUCCUGGGAGUACCCCGACACAUGGUCCACCCCCCAUUCCUAU UUCUCCCUGACCUUUUGCGUGCAGGUGCAGGGCAAGAGCAAGAGGGAGAAAAAGGA CAGGGUGUUCACCGACAAGACCUCCGCCACCGUGAUCUGCCGUAAGAACGCUAGCA UCAGCGUCAGGGCCCAGGACAGGUACUAUAGCAGCUCCUGGUCCGAGUGGGCCAGC GUCCCCGUGCAGCGGCGGGGGCGGUGGAGGCUCCCGGAACCUCCCCGUGGCCACCCC GGACCCCGGGAUGUUUCCCUGCCUGCAUCACAGCCAGAACCUGCUGAGGGCCGUGU CCAACAUGCUGCAGAAGGCCAGGCAGACACUCGAGUUUUACCCCUGCACCAGCGAG GAGAUCGACCACGAAGACAUCACCAAGGACAAGACCUCCACCGUGGAGGCAUGCCU GCCCCUGGAGCUGACCAAAAACGAAAGCUGUCUGAACUCCAGGGAGACCUCCUUUA UCACGAACGGCUCAUGCCUGGCCUCCAGAAAGACCAGCUUCAUGAUGGCCCUGUGC CUGAGCUCCAUCUACGAGGACUUGAAAAUGUACCAGGUCGAGUUCAAGACCAUGAA CGCCAAGCUGCUCAUGGACCCCAAAAGGCAGAUCUUUCUGGACCAGAAUAUGCUGG CCGUGAUCGACGAGCUCAUGCAAGCCCUGAAUUUCAACAGCGAGACCGUGCCCCAG AAGUCCUCCCUGGAGGAGCCCGACUUCUACAAGACCAAGAUCAAGCUGUGCAUACU CCUGCACGCGUUUAGGAUCAGGGCCGGUGACCAUCGAUAGGGUGAUGAGCUACCUGA AUGCCUCCUGAUAAUAGGCUGGAGCCUCGGUGGCCAUGCUUCUUGCCCCUUGGGCC UCCCCCCAGCCCCUCCUCCCCUUCCUGCACCCGUACCCCCCAAACACCAUUGUCAC ACUCCAGUGGUCUUUGAAUAAAGUCUGAGUGGGCGGC |

-continued

SUMMARY OF SEQUENCES

| SEQ ID NO | Description | Sequence |
|---|---|---|
| 372 | IL12B signal peptide nucleotide sequence | AUGUGCCACCAGCAGCUGGUGAUCAGCUGGUUCAGCCUGGUGUUCCUGGCCAGCCCCCUGGUGGCC |
| 373 | IL-12B nucleotide sequence | AUCUGGGAGCUGAAGAAGGACGUGUACGUGGUGGAGUUGGAUUGGUACCCCGACGCCCCCGGCGAGAUGGUGGUGCUGACCUGCGACACCCCCGAGGAGGACGGCAUCACCUGGACCCUGGACCAGAGCAGCGAGGUGCUGGGCAGCGGCAAGACCCUGACCAUCCAGGUGAAGGAGUUCGGCGACGCCGGCCAGUACACCUGCCACAAGGGCGGCGAGGUGCUGAGCCACAGCCUGCUGCUGCUGCACAAGAAGGAGGACGGCAUCUGGAGCACCGACAUCCUGAAGGACCAGAAGGAGCCCAAGAACAAGACCUUCCUGAGAUGCGAGGCCAAGAACUACAGCGGCAGAUUCACCUGCUGGUGGCUGACCACCAUCAGCACCGACCUGACCUUCAGCGUGAAGAGCAGCAGAGGCAGCAGCGACCCCCAGGGCGUGACCUGCGGCGCCGCCACCCUGAGCGCCGAGAGAGUGAGAGGCGACAACAAGGAGUACGAGUACAGCGUGGAGUGCCAGGAAGAUAGCGCCUGCCCCGCCGCCGAGGAGAGCCUGCCCAUCGAGGUGAUGGUGGACGCCGUGCACAAGCUGAAGUACGAGAACUACACCAGCAGCUUCUUCAUCAGAGAUAUCAUCAAGCCCGACCCCCCCAAGAACCUGCAGCUGAAGCCCCUGAAGAACAGCCGGCAGGUGGAGGUGAGCUGGGAGUACCCCGACACCUGGAGCACCCCCCACAGCUACUUCAGCCUGACCUUCUGCGUGCAGGUGCAGGGCAAGAGCAAGAGAGAAGAAAGAUAGAGUGUUCACCGACAAGACCAGCGCCACCGUGAUCUGCAGAAAGAACGCCAGCAUCAGCGUGAGAGCCCAAGAUAGAUACUACAGCAGCAGCUGGAGCGAGUGGGCCAGCGUGCCCUGCAGC |
| 374 | GGGGGGS nucleotide sequence | GGCGGCGGCGGCGGCGGCAGC |
| 375 | IL-12A nucleotide sequence | AGAAACCUGCCCGUGGCCACCCCCGACCCCGGCAUGUUCCCCUGCCUGCACCACAGCCAGAACCUGCUGAGAGCCGUGAGCAACAUGCUGCAGAAGGCCCGGCAGACCCUGGAGUUCUACCCCUGCACCAGCGAGGAGAUCGACCACGAAGAUAUCACCAAAGAUAAGACCAGCACCCGUGGAGGCCUGCCUGCCCCUGGAGCUGACCAAGAACGAGAGCUGCCUGAACAGCAGAGAGACCAGCUUCAUCACCAACGGCAGCUGCCUGGCCAGCAGAAAGACCAGCUUCAUGAUGGCCCUGUGCCUGAGCAGCAUCUACGAGGACCUGAAGAUGUACCAGGUGGAGUUCAAGACCAUGAACGCCAAGCUGCUGAUGGACCCCAAGCGGCAGAUCUUCCUGGACCAGAACAUGCUGGCCGUGAUCGACGAGCUGAUGCAGGCCCUGAACUUCAACAGCGAGACCGUGCCCCAGAAGAGCAGCCUGGAGGAGCCCGACUUCUACAAGACCAAGAUCAAGCUGUGCAUCCUGCUGCACGCCUUCAGAAUCAGAGCCGUGACCAUCGACAGAGUGAUGAGCUACCUGAACGCCAGC |
| 376 | Linker nucleotide sequence | UCUGGUGGCGGAUCAGGCGGCGGCGGUUCAGGAGGCGGUGGAAGUGGAGGUGGCGGGUCUGGCGGAGGUUCACUGCAG |
| 377 | Human CD8 transmembrane nucleotide sequence | AUCUACAUCUGGGCUCCACUGGCCGGCACCUGCGGCGUGCUGCUGCUGAGCCUGGUGAUCACCCUGUACUGCUAC |
| 378 | Human CD80 transmembrane domain nucleotide sequence | CUGCUGCCCAGCUGGGCCAUCACCCUGAUCAGCGUGAACGGCAUCUUCGUGAUCUGCUGCCUG |
| 379 | Human CD80 intracellular domain nucleotide sequence | ACCUACUGCUUCGCCCCUCGAUGCAGAGAGAGAAGAAGAAACGAGAGACUGAGAAGAGAGAGCGUGCGACCCGUG |

SEQUENCE LISTING (379 sequences)

SEQ ID NO: 1 - protein, 306 aa, Artificial Sequence
  Synthetic: Wild Type IL12B without signal (IL12B) Amino Acids
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 2 - DNA, 918 bp, Artificial Sequence
  Synthetic: Wild Type IL12B without signal (IL12B) Nucleic Acids
atatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagt

SEQ ID NO: 3 - protein, 197 aa, Artificial Sequence
  Synthetic: Wild Type IL12A without signal peptide Amino acids
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 4 - DNA, 591 bp, Artificial Sequence
  Synthetic: Wild Type IL12A without signal peptide Nucleic acids
agaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcc

SEQ ID NO: 5 - DNA, 1596 bp, Artificial Sequence
  Synthetic: hIL12AB_001 ORF
atgtgtcaccagcagctggtcattagctggtttagccttgtgttcctggcctccccccttgtcgctatttgggagctcaagaaggacgtgtacgtggtggagctggactggtacccagacgcgcccggagagatggtagttctgacctgtgataccccagaggaggacggcatcacctggactctggaccaaagcagcgaggttttgggctcagggaaaacgctgaccatccaggtgaaggaattcggcgacgccggacagtacacctgccataagggaggagaggtgctgagccattcccttcttctgctgcacaagaaagaggacggcatctggtctaccgacatcctgaaagaccagaaggagcccaagaacaaaaccttcctgaggtgcgaggccaagaactactccggcaggttcacttgttggtggctgaccaccatcagtacagacctgacttttagtgtaaaaagctccagaggctcgtccgatccccaaggggtgacctgcggcgcagccactctgagcgctgagcgcgtgcgcggtgacaataaagagtacgagtacagcgttgagtgtcaagaagacagcgcttgccctgccgccgaggagagcctgcctatcgaggtgatggttgacgcagtgcacaagcttaagtacgagaattacaccagctcattcttcattagagatataatcaagcctgacccacccaagaacctgcagctgaagccactgaaaaactcacggcaggtcgaagtgagctgggagtaccccgacacctggagcactcctcattcctatttctctcttacattctgcgtccaggtgcagggcaagagcaagcgggaaaagaaggatcgagtcttcaccgacaaaacaagcgcgaccgtgatttgcaggaagaacgccagcatctccgtcagagcccaggatagatactatagtagcagctggagcgagtgggcaagcgtgccctgttccggcggcgggggcgggggcagccgaaacttgcctgtcgctaccccggaccctggaatgtttccgtgtctgcaccacagccagaacctgctgagagccgtgtcgaatatgctccagaaggcccggcagacccttgagttctacccctgtaccagcgaagagatcgatcatgaggacatcacgaaagacaagacttccaccgtcgaggcttgtctcccgctggagctgaccaagaacgagagctgtctgaatagccgggagacatctttcatcacgaatggtagctgtctggccagcaggaaaacttccttcatgatggctctctgcctgagctctatctatgaagatctgaagatgtatcaggtggagtttaagactatgaacgccaaactcctgatggacccaaaaaggcaaatctttctggaccagaatatgctggccgtgatagacgagctgatgcaggcactgaacttcaacagcgagacagtgccacagaaatccagcctggaggagcctgacttttacaaaactaagatcaagctgtgtatcctgctgcacgcctttagaatccgtgccgtgactatcgacagggtgatgtcatacctcaacgcttca

SEQ ID NO: 6 - DNA, 1596 bp, Artificial Sequence
  Synthetic: hIL12AB_002 ORF
atgtgccaccagcagctggtgatcagctggttcagcctggtgttcctggccagccccctggtggccatctgggagctgaagaaggacgtgtacgtggtggagctggactggtaccccgacgcccccggcgagatggtggtgctgacctgcgacacccccgaggaggacggcatcacctggaccctggaccagagcagcgaggtgctgggcagcggcaagaccctgaccatccaggtgaaggagttcggcgacgccggccagtacacctgccacaagggcggcgaggtgctgagccacagcctgctgctgctgcacaagaaggaggacggcatctggagcaccgacatcctgaaggaccagaaggagcccaagaacaagaccttcctgagatgcgaggccaagaactacagcggcagattcacctgctggtggctgaccaccatcagcaccgacctgaccttcagcgtgaagagcagcagaggcagcagcgacccccagggcgtgacctgcggcgccgccaccctgagcgccgagagagtgagaggcgacaacaaggagtacgagtacagcgtggagtgccaggaggacagcgcctgccccgccgccgaggagagcctgcccatcgaggtgatggtggacgccgtgcacaagctgaagtacgagaactacaccagcagcttcttcatcagagacatcatcaagcccgacccccccaagaacctgcagctgaagcccctgaagaacagcagacaggtggaggtgagctgggagtaccccgacacctggagcaccccccacagctacttcagcctgaccttctgcgtgcaggtgcagggcaagagcaagagagagaagaaggacagagtgttcaccgacaagaccagcgccaccgtgatctgcagaaagaacgccagcatcagcgtgagagcccaggacagatactacagcagcagctggagcgagtgggccagcgtgccctgcagcggcggcggcggcggcggcagcagaaacctgcccgtggccacccccgaccccggcatgttcccctgcctgcaccacagccagaacctgctgagagccgtgagcaacatgctgcagaaggccagacagaccctggagttctacccctgcaccagcgaggagatcgaccacgaggacatcaccaaggacaagaccagcaccgtggaggcctgcctgcccctggagctgaccaagaacgagagctgcctgaacagcagagagaccagcttcatcaccaacggcagctgcctggccagcagaaagaccagcttcatgatggccctgtgcctgagcagcatctacgaggacctgaagatgtaccaggtggagttcaagaccatgaacgccaagctgctgatggaccccaagagacagatcttcctggaccagaacatgctggccgtgatcgacgagctgatgcaggccctgaacttcaacagcgagaccgtgccccagaagagcagcctggaggagcccgacttctacaagaccaagatcaagctgtgcatcctgctgcacgccttcagaatcagagccgtgaccatcgacagagtgatgagctacctgaacgccagc

SEQ ID NO: 7 - DNA, 1596 bp, Artificial Sequence
  Synthetic: hIL12AB_003  ORF
atgtgtcaccagcagttggtcatctcttggttttccctggtttttctggcatctcccctcgtggccatatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagtggcggagggggcggagggagcagaaacctccccgtggccactccagacccaggaatgttcccatgccttcaccactcccaaaacctgctgagggccgtcagcaacatgctccagaaggccagacaaactttagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttttagatcaaaacatgctggcagttattgatgagctgatgcaggccctgaatttcaacagtgagactgtgccacaaaaatcctcccttgaagaaccggacttctacaagaccaagatcaagctctgcatacttcttcatgctttcagaattcgggcagtgactattgatagagtgatgagctatctgaatgcttcc

SEQ ID NO: 8 - DNA, 1599 bp, Artificial Sequence
  Synthetic: hIL12AB_004 ORF
atgggctgccaccagcagctggtcatcagctggttctccctggtcttcctggccagccccctggtggccatctgggagctgaagaaagatgtctatgttgtagagctggactggtacccagatgctcctggagaaatggtggttctcacctgtgacacgccagaagaagatggcatcacctggacgctggaccagagctcagaagttcttggcagtggaaaaacgctgaccatacaagtaaaagaatttggggatgctggccagtacacctgccacaaaggaggagaagttctcagccacagcctgctgctgctgcacaagaaagaagatggcatctggagcacagacattttaaaagaccagaaggagcccaagaacaaaaccttccttcgatgtgaggccaagaactacagtggccgcttcacctgctggtggctcaccaccatcagcacagacctcaccttctcggtgaagagcagccgtggcagctcagacccccaaggagtcacctgtggggcggccacgctgtcggcagaaagagttcgaggggacaacaaggaatatgaatactcggtggaatgtcaagaagactcggcctgcccggcggcagaagaaagtcttcccatagaagtcatggtggatgctgttcacaaattaaaatatgaaaactacaccagcagcttcttcatcagagacatcatcaagccagacccgcccaagaacctgcagctgaagcccctgaagaacagcagacaagtggaagtttcctgggagtacccagacacgtggagcacgccgcacagctacttcagcctcaccttctgtgtacaagtacaaggcaagagcaagagagagaagaaagatcgtgtcttcacagacaaaacctcggcgacggtcatctgcaggaagaatgcctccatctcggttcgagcccaggaccgctactacagcagcagctggagtgagtgggcctcggtgccctgcagtggtggcggcggcggcggcagcagaaaccttcctgtggccacgccggaccctggcatgttcccgtgcctgcaccacagccaaaatttacttcgagctgtttctaacatgctgcagaaagcaagacaaactttagaattctacccctgcacctcagaagaaatagaccatgaagacatcaccaaagataaaaccagcactgtagaggcctgcctgcccctggagctcaccaagaatgaatcctgcctcaacagcagagagaccagcttcatcaccaatggcagctgcctggccagcaggaaaaccagcttcatgatggcgctctgcctgagcagcatctatgaagatttgaagatgtaccaagtagaatttaaaaccatgaatgccaagctgctcatggaccccaagagacaaatatttttggatcaaaacatgctggctgtcattgatgagctcatgcaagcattaaacttcaactcagagacggtgccccagaagagcagcctggaggagccagacttctacaaaaccaagatcaagctctgcatcttattacatgccttccgcatccgggcggtcaccattgaccgtgtcatgtcctacttaaatgccagc

SEQ ID NO: 9 - DNA, 1596 bp, Artificial Sequence
  Synthetic: hIL12AB_005 ORF
atgtgccaccagcagctggtcatcagctggttctccctggtcttcctggccagccccctggtggccatctgggagctgaagaaagatgtctatgttgtagagctggactggtacccagatgctcctggagaaatggtggttctcacctgtgacacgccagaagaagatggcatcacctggacgctggaccagagctcagaagttcttggcagtggaaaaacgctgaccatacaagtaaaagaatttggggatgctggccagtacacctgccacaaaggaggagaagttctcagccacagcctgctgctgctgcacaagaaagaagatggcatctggagcacagacattttaaaagaccagaaggagcccaagaacaaaaccttccttcgatgtgaggccaagaactacagtggccgcttcacctgctggtggctcaccaccatcagcacagacctcaccttctcggtgaagagcagccgtggcagctcagacccccaaggagtcacctgtggggcggccacgctgtcggcagaaagagttcgaggggacaacaaggaatatgaatactcggtggaatgtcaagaagactcggcctgcccggcggcagaagaaagtcttcccatagaagtcatggtggatgctgttcacaaattaaaatatgaaaactacaccagcagcttcttcatcagagacatcatcaagccagacccgcccaagaacctgcagctgaagcccctgaagaacagcagacaagtggaagtttcctgggagtacccagacacgtggagcacgccgcacagctacttcagcctcaccttctgtgtacaagtacaaggcaagagcaagagagagaagaaagatcgtgtcttcacagacaaaacctcggcgacggtcatctgcaggaagaatgcctccatctcggttcgagcccaggaccgctactacagcagcagctggagtgagtgggcctcggtgccctgcagtggtggcggcggcggcggcagcagaaaccttcctgtggccacgccggaccctggcatgttcccgtgcctgcaccacagccaaaatttacttcgagctgtttctaacatgctgcagaaagcaagacaaactttagaattctacccctgcacctcagaagaaatagaccatgaagacatcaccaaagataaaaccagcactgtagaggcctgcctgcccctggagctcaccaagaatgaatcctgcctcaacagcagagagaccagcttcatcaccaatggcagctgcctggccagcaggaaaaccagcttcatgatggcgctctgcctgagcagcatctatgaagatttgaagatgtaccaagtagaatttaaaaccatgaatgccaagctgctcatggaccccaagagacaaatatttttggatcaaaacatgctggctgtcattgatgagctcatgcaagcattaaacttcaactcagagacggtgccccagaagagcagcctggaggagccagacttctacaaaaccaagatcaagctctgcatcttattacatgccttccgcatccgggcggtcaccattgaccgtgtcatgtcctacttaaatgccagc

SEQ ID NO: 10 - DNA, 1596 bp, Artificial Sequence
  Synthetic: hIL12AB_006 ORF
atgtgccaccagcagctggtgatcagctggttcagcctggtgttcctggccagccccctggtggccatctgggagctgaagaaggacgtgtacgtggtggagctggactggtaccccgacgcccccggcgagatggtggtgctgacctgtgacacccccgaggaggacggcatcacctggaccctggaccagagcagcgaggtgctgggcagcggcaagaccctgaccatccaggtgaaggagttcggggacgccggccagtacacctgccacaagggcggcgaggtgctgagccacagcctgctgctgctgcacaagaaggaggacggcatctggagcacagatatcctgaaggaccagaaggagcccaagaacaagaccttcctgagatgcgaggccaagaactacagcggcagattcacctgctggtggctgaccaccatcagcacagacttgaccttcagcgtgaagagcagcagaggcagcagcgacccccagggcgtgacctgcggcgccgccaccctgagcgccgagagagtgagaggggacaacaaggagtacgagtacagcgtggagtgccaggaggacagcgcctgccccgccgccgaggagagcctgcccatcgaggtgatggtggacgccgtgcacaagctgaagtacgagaactacaccagcagcttcttcatcagagacatcatcaagcccgacccgccgaagaacctgcagctgaagcccctgaagaacagcagacaggtggaggtgagctgggagtaccccgacacctggagcaccccccacagctacttcagcctgaccttctgcgtgcaggtgcagggcaagagcaagagagagaagaaggacagagtgttcacagataagaccagcgccaccgtgatctgcagaaagaacgccagcatcagcgtgagagcccaggacagatactacagcagcagctggagcgagtgggccagcgtgccctgcagcggcggcggcggcggcggcagcagaaacctgcccgtggccacccccgaccccggcatgttcccctgcctgcaccacagccagaacctgctgagagccgtgagcaacatgctgcagaaggccagacagaccctggagttctacccctgcaccagcgaggagatcgaccacgaggacatcaccaaggacaagaccagcaccgtggaggcctgcctgcccctggagctgaccaagaatgaaagctgcctgaacagcagagagaccagcttcatcaccaacggcagctgcctggccagcagaaagaccagcttcatgatggccctgtgcctgagcagcatctacgaggacctgaagatgtaccaggtggagttcaagaccatgaacgccaagctgctgatggaccccaagagacagatcttcctggaccagaacatgctggccgtgatcgacgagctgatgcaggccctgaacttcaacagcgagaccgtgccccagaagagcagcctggaggagcccgacttctacaagaccaagatcaagctgtgcatcctgctgcacgccttcagaatcagagccgtgaccatcgacagagtgatgagctacctgaacgccagc

SEQ ID NO: 11 - DNA, 1596 bp, Artificial Sequence
  Synthetic: hIL12AB_007 ORF
atgtgccaccagcagcttgtcatctcctggttctctcttgtcttccttgcttctcctcttgtggccatctgggagctgaagaaggatgtttatgttgtggagttggactggtaccctgatgctcctggagaaatggtggttctcacctgtgacactcctgaggaggatggcatcacctggactttggaccagtcttctgaggttcttggcagtggaaaaactcttactattcaggtgaaggagtttggagatgctggccagtacacctgccacaagggtggtgaagttctcagccacagtttacttcttcttcacaagaaggaggatggcatctggtctactgacattttaaaagaccagaaggagcccaagaacaagactttccttcgttgtgaagccaagaactacagtggtcgtttcacctgctggtggcttactactatttctactgaccttactttctctgtgaagtcttctcgtggctcttctgaccctcagggtgtcacctgtggggctgctactctttctgctgagcgtgtgcgtggggacaacaaggagtatgaatactcggtggagtgccaggaggactctgcctgccctgctgctgaggagtctcttcctattgaggtgatggtggatgctgtgcacaagttaaaatatgaaaactacacttcttctttcttcattcgtgacattataaaacctgaccctcccaagaaccttcagttaaaacctttaaaaaactctcgtcaggtggaggtgtcctgggagtaccctgacacgtggtctactcctcactcctacttctctcttactttctgtgtccaggtgcagggcaagtccaagcgtgagaagaaggaccgtgtcttcactgacaagacttctgctactgtcatctgcaggaagaatgcatccatctctgtgcgtgctcaggaccgttactacagctcttcctggtctgagtgggcttctgtgccctgctctggcggcggcggcggcggcagcagaaatcttcctgtggctactcctgaccctggcatgttcccctgccttcaccactcgcagaaccttcttcgtgctgtgagcaacatgcttcagaaggctcgtcagactttagaattctacccctgcacttctgaggagattgaccatgaagacatcaccaaggacaagacttctactgtggaggcctgccttcctttagagctgaccaagaatgaatcctgcttaaattctcgtgagacttctttcatcaccaatggcagctgccttgcctcgcgcaagacttctttcatgatggctctttgcctttcttccatctatgaagacttaaaaatgtaccaggtggagttcaagaccatgaatgcaaagcttctcatggaccccaagcgtcagatatttttggaccagaacatgcttgctgtcattgatgagctcatgcaggctttaaacttcaactctgagactgtgcctcagaagtcttctttagaagagcctgacttctacaagaccaagataaaactttgcattcttcttcatgctttccgcatccgtgctgtgactattgaccgtgtgatgtcctacttaaatgcttct

SEQ ID NO: 12 - DNA, 1596 bp, Artificial Sequence
  Synthetic: hIL12AB_008 ORF
atgtgtcatcaacaactcgtgattagctggttcagtctcgtgttcctggcctctccgctggtggccatctgggagcttaagaaggacgtgtacgtggtggagctcgattggtaccccgatgctcctggcgagatggtggtgctaacctgcgatacccccgaggaggacgggatcacttggaccctggatcagagtagcgaagtcctgggctctggcaagacactcacaatccaggtgaaggaattcggagacgctggtcagtacacttgccacaaggggggtgaagtgctgtctcacagcctgctgttactgcacaagaaggaggatgggatctggtcaaccgacatcctgaaggatcagaaggagcctaagaacaagacctttctgaggtgtgaagctaagaactattccggaagattcacttgctggtggttgaccacaatcagcactgacctgaccttttccgtgaagtccagcagaggaagcagcgatcctcagggcgtaacgtgcggcgcggctaccctgtcagctgagcgggttagaggcgacaacaaagagtatgagtactccgtggagtgtcaggaggacagcgcctgccccgcagccgaggagagtctgcccatcgaggtgatggtggacgctgtccataagttaaaatacgaaaattacacaagttcctttttcatccgcgatattatcaaacccgatccccccaagaacctgcagctgaagcccctgaagaatagccgacaggtggaagtctcttgggagtatcctgacacctggtccacgcctcacagctactttagtctgactttctgtgtccaggtccagggcaagagcaagagagagaaaaaggatagagtgtttactgacaagacatctgctacagtcatctgcagaaagaacgccagtatctcagtgagggcgcaggacagatactacagtagtagctggagcgaatgggctagcgtgccctgttcagggggcggcggagggggctccaggaatctgcccgtggccacccccgaccctgggatgttcccttgcctccatcactcacagaacctgctcagagcagtgagcaacatgctccaaaaggcccgccagaccctggagttttacccttgtacttcagaagagatcgatcacgaagacataacaaaggataaaaccagcaccgtggaggcctgtctgcctctagaactcacaaagaatgaaagctgtctgaattccagggaaacctccttcattactaacggaagctgtctcgcatctcgcaaaacatcattcatgatggccctctgcctgtcttctatctatgaagatctcaagatgtatcaggtggagttcaaaacaatgaacgccaagctgctgatggaccccaagagacagatcttcctggaccagaacatgctggcagtgatcgatgagctgatgcaagccttgaacttcaactcagagacagtgccgcaaaagtcctcgttggaggaaccagatttttacaaaaccaaaatcaagctgtgtatccttcttcacgcctttcggatcagagccgtgactatcgaccgggtgatgtcatacctgaatgcttcc

SEQ ID NO: 13 - DNA, 1596 bp, Artificial Sequence
  Synthetic: hIL12AB_009 ORF
atgtgccaccagcagctggtcatcagctggtttagcctggtcttcctggccagccccctggtggccatctgggagctgaagaaagatgtctatgttgtagagctggactggtacccagatgctcctggagaaatggtggttctcacctgcgacacgccagaagaagatggcatcacctggacgctggaccagagcagcgaagtactgggcagtggaaaaacgctgaccatacaagtaaaagaatttggcgatgctggccagtacacctgccacaaaggaggagaagtactgagccacagcctgctgctgctgcacaagaaagaagatggcatctggagcaccgacattttaaaagaccagaaggagcccaagaacaaaaccttccttcgatgtgaggcgaagaactacagtggccgcttcacctgctggtggctcaccaccatcagcaccgacctcaccttctcggtgaagagcagccgtggtagctcagacccccaaggagtcacctgtggggcggccacgctgtcggcagaaagagttcgaggcgacaacaaggaatatgaatactcggtggaatgtcaagaagactcggcctgcccggcggcagaagaaagtctgcccatagaagtcatggtggatgctgttcacaaattaaaatatgaaaactacaccagcagcttcttcatcagagacatcatcaagccagacccccccaagaacctgcagctgaagcccctgaagaacagcagacaagtggaagtttcctgggagtacccagacacgtggagcacgccgcacagctacttcagcctcaccttctgtgtacaagtacaaggcaagagcaagagagagaagaaagatcgtgtcttcaccgacaaaacctcggcgacggtcatctgcaggaagaatgcaagcatctcggttcgagcccaggaccgctactacagcagcagctggagtgagtgggcctcggtgccctgcagtggtggcggcggcggcggcagcagaaaccttcctgtggccacgccggaccctggcatgtttccgtgcctgcaccacagccaaaatttattacgagctgttagcaacatgctgcagaaagcaagacaaactttagaattctacccctgcacctcagaagaaatagaccatgaagacatcaccaaagataaaaccagcactgtagaggcctgcctgcccctggagctcaccaagaacgagagctgcctcaatagcagagagaccagcttcatcaccaatggcagctgcctggccagcaggaaaaccagcttcatgatggcgctctgcctgagcagcatctatgaagatctgaagatgtaccaagtagaatttaaaaccatgaatgccaagctgctcatggaccccaagagacaaatattcctcgaccaaaacatgctggctgtcattgatgagctcatgcaagcattaaacttcaactcagagacggtgccccagaagagcagcctggaggagccagacttctacaaaaccaagatcaagctctgcatcttattacatgccttccgcatccgggcggtcaccattgaccgtgtcatgtcctacttaaatgccagc

SEQ ID NO: 14 - DNA, 1596 bp, Artificial Sequence
  Synthetic: hIL12AB_010 ORF
atgtgccaccagcagcttgtcatctcctggttttctcttgtcttcctcgcttctcctcttgtggccatctgggagctgaagaaagatgtctatgttgtagagctggactggtacccggacgctcctggagaaatggtggttctcacctgcgacactcctgaagaagatggcatcacctggacgctggaccaaagcagcgaagttttaggctctggaaaaacgctgaccatacaagtaaaagaatttggcgacgctggccagtacacgtgccacaaaggaggagaagttttaagccacagtttacttcttcttcacaagaaagaagatggcatctggagtacggacattttaaaagaccagaaggagcctaagaacaaaaccttcctccgctgtgaagctaagaactacagtggtcgtttcacctgctggtggctcaccaccatctccactgacctcaccttctctgtaaaatcaagccgtggttcttctgacccccaaggagtcacctgtggggctgccacgctcagcgctgaaagagttcgaggcgacaacaaggaatatgaatattctgtggaatgtcaagaagattctgcctgcccggcggcagaagaaagtcttcccatagaagtcatggtggacgctgttcacaaattaaaatatgaaaactacaccagcagcttcttcattcgtgacatcatcaaaccagaccctcctaagaaccttcagttaaaaccgctgaagaacagcagacaagtggaagtttcctgggagtacccggacacgtggagtacgccgcactcctacttcagtttaaccttctgtgtacaagtacaaggaaaatcaaaaagagagaagaaagatcgtgtcttcactgacaaaacatctgccacggtcatctgccgtaagaacgcttccatctcggttcgagcccaggaccgctactacagcagcagctggagtgagtgggcatctgttccctgcagtggtggcggcggcggcggcagccgcaaccttcctgtggccacgccggaccctggcatgttcccgtgccttcaccactcgcaaaatcttcttcgtgctgtttctaacatgctgcagaaggcgagacaaactttagaattctacccgtgcacttctgaagaaatagaccatgaagacatcaccaaggacaaaaccagcacggtggaggcctgccttcctttagaacttactaagaacgaaagttgccttaacagccgtgagaccagcttcatcaccaatggcagctgccttgctagcaggaagaccagcttcatgatggcgctgtgcctttcttccatctatgaagatcttaagatgtaccaagtagaatttaaaaccatgaatgccaaattattaatggaccccaagagacaaatattcctcgaccaaaacatgctggctgtcattgatgagctcatgcaagcattaaacttcaactcagaaactgttccccagaagtcatctttagaagaaccggacttctacaaaacaaaaataaaactctgcattcttcttcatgccttccgcatccgtgctgtcaccattgaccgtgtcatgtcctacttaaatgcttct

SEQ ID NO: 15 - DNA, 1596 bp, Artificial Sequence
  Synthetic: hIL12AB_011 ORF
atgtgccaccagcagctggtgatcagctggttcagcctggtgttcctggccagccccctggtggccatctgggagctgaagaaggacgtgtacgtggtggagctggactggtacccggacgcgccgggggagatggtggtgctgacgtgcgacacgccggaggaggacgggatcacgtggacgctggaccagagcagcgaggtgctggggagcgggaagacgctgacgatccaggtgaaggagttcggggacgcggggcagtacacgtgccacaaggggggggaggtgctgagccacagcctgctgctgctgcacaagaaggaggacgggatctggagcacggacatcctgaaggaccagaaggagccgaagaacaagacgttcctgaggtgcgaggcgaagaactacagcgggaggttcacgtgctggtggctgacgacgatcagcacggacctgacgttcagcgtgaagagcagcagggggagcagcgacccgcagggggtgacgtgcggggcggcgacgctgagcgcggagagggtgaggggggacaacaaggagtacgagtacagcgtggagtgccaggaggacagcgcgtgcccggcggcggaggagagcctgccgatcgaggtgatggtggacgcggtgcacaagctgaagtacgagaactacacgagcagcttcttcatcagggacatcatcaagccggacccgccgaagaacctgcagctgaagccgctgaagaacagcaggcaggtggaggtgagctgggagtacccggacacgtggagcacgccgcacagctacttcagcctgacgttctgcgtgcaggtgcaggggaagagcaagagggagaagaaggacagggtgttcacggacaagacgagcgcgacggtgatctgcaggaagaacgcgagcatcagcgtgagggcgcaggacaggtactacagcagcagctggagcgagtgggcgagcgtgccgtgcagcggggggggggggggggggagcaggaacctgccggtggcgacgccggacccggggatgttcccgtgcctgcaccacagccagaacctgctgagggcggtgagcaacatgctgcagaaggcgaggcagacgctggagttctacccgtgcacgagcgaggagatcgaccacgaggacatcacgaaggacaagacgagcacggtggaggcgtgcctgccgctggagctgacgaagaacgagagctgcctgaacagcagggagacgagcttcatcacgaacgggagctgcctggcgagcaggaagacgagcttcatgatggcgctgtgcctgagcagcatctacgaggacctgaagatgtaccaggtggagttcaagacgatgaacgcgaagctgctgatggacccgaagaggcagatcttcctggaccagaacatgctggcggtgatcgacgagctgatgcaggcgctgaacttcaacagcgagacggtgccgcagaagagcagcctggaggagccggacttctacaagacgaagatcaagctgtgcatcctgctgcacgcgttcaggatcagggcggtgacgatcgacagggtgatgagctacctgaacgcgagc

SEQ ID NO: 16 - DNA, 1596 bp, Artificial Sequence
  Synthetic: hIL12AB_012 ORF
atgtgccatcagcagctggtgatcagctggttcagcctcgtgtttctggccagccccctggtggccatttgggaactcaagaaggacgtgtatgtagtggaactcgactggtaccctgacgccccaggcgaaatggtggtcttaacctgcgacacccctgaggaggacggaatcacctggaccttggaccagagctccgaggtcctcggcagtggcaagaccctgaccatacaggtgaaagaatttggagacgcagggcaatacacatgtcacaagggcggggaggttctttctcactcccttctgcttctacataaaaaggaagacggaatttggtctaccgacatcctcaaggaccaaaaggagcctaagaataaaaccttcttacgctgtgaagctaaaaactacagcggcagattcacttgctggtggctcaccaccatttctaccgacctgaccttctcggtgaagtcttcaaggggctctagtgatccacagggagtgacatgcggggccgccacactgagcgctgaacgggtgaggggcgataacaaggagtatgaatactctgtcgagtgtcaggaggattcagcttgtcccgcagctgaagagtcactccccatagaggttatggtcgatgctgtgcataaactgaagtacgaaaactacaccagcagcttcttcattcgggacattataaaacctgacccccccaagaacctgcaacttaaacccctgaaaaactctcggcaggtcgaagttagctgggagtaccctgatacttggtccaccccccactcgtacttctcactgactttctgtgtgcaggtgcagggcaagagcaagagagagaaaaaagatcgtgtattcacagacaagacctctgccaccgtgatctgcagaaaaaacgcttccatcagtgtcagagcccaagaccggtactatagtagtagctggagcgagtgggcaagtgtcccctgctctggcggcggagggggcggctctcgaaacctccccgtcgctacccctgatccaggaatgttcccttgcctgcatcactcacagaatctgctgagagcggtcagcaacatgctgcagaaagctaggcaaacactggagttttatccttgtacctcagaggagatcgaccacgaggatattaccaaggacaagaccagcacggtggaggcctgcttgcccctggaactgacaaagaatgaatcctgccttaatagccgtgagacctcttttataacaaacggatcctgcctggccagcaggaagacctccttcatgatggccctctgcctgtcctcaatctacgaagacctgaagatgtaccaggtggaatttaaaactatgaacgccaagctgttgatggaccccaagcggcagatctttctggatcaaaatatgctggctgtgatcgacgaactgatgcaggccctcaactttaacagcgagaccgtgccacaaaagagcagtcttgaggagcccgacttctacaagaccaagatcaagctgtgcatcctccttcatgccttcaggataagagctgtcaccatcgacagagtcatgagttacctgaatgcatcc

SEQ ID NO: 17 - DNA, 1596 bp, Artificial Sequence
  Synthetic: hIL12AB_013 ORF
atgtgccaccagcagctggtcatctcctggttcagtcttgtcttcctggcctcgccgctggtggccatctgggagctgaagaaagatgtttatgttgtagagctggactggtacccagatgctcctggagaaatggtggtcctcacctgtgacacgccagaagaagatggcatcacctggacgctggaccagagcagtgaagttcttggaagtggaaaaacgctgaccatacaagtaaaagaatttggagatgctggccagtacacctgccacaaaggaggagaagttctcagccacagtttattattacttcacaagaaagaagatggcatctggtccacggacattttaaaagaccagaaggagcccaaaaataaaacatttcttcgatgtgaggccaagaactacagtggtcgtttcacctgctggtggctgaccaccatctccacagacctcaccttcagtgtaaaaagcagccgtggttcttctgacccccaaggagtcacctgtggggctgccacgctctctgcagaaagagttcgaggggacaacaaagaatatgagtactcggtggaatgtcaagaagactcggcctgcccagctgctgaggagagtcttcccatagaagtcatggtggatgctgttcacaaattaaaatatgaaaactacaccagcagcttcttcatcagagacatcatcaaacctgacccgcccaagaacttacagctgaagccgctgaaaaacagcagacaagtagaagtttcctgggagtacccggacacctggtccacgccgcactcctacttctccctcaccttctgtgtacaagtacaaggcaagagcaagagagagaagaaagatcgtgtcttcacggacaaaacatcagccacggtcatctgcaggaaaaatgccagcatctcggtgcgggcccaggaccgctactacagcagcagctggagtgagtgggcatctgtgccctgcagtggtggtgggggtggtggcagcagaaaccttcctgtggccactccagaccctggcatgttcccgtgccttcaccactcccaaaatttacttcgagctgtttctaacatgctgcagaaagcaagacaaactttagaattctacccgtgcacttctgaagaaattgaccatgaagacatcacaaaagataaaaccagcacagtggaggcctgtcttcctttagagctgaccaaaaatgaatcctgcctcaacagcagagagaccagcttcatcaccaatggcagctgcctggcctccaggaaaaccagcttcatgatggcgctctgcctcagctccatctatgaagatttgaagatgtaccaagtagaatttaaaaccatgaatgccaaattattaatggaccccaagaggcagatatttttagatcaaaacatgctggcagttattgatgagctcatgcaagcattaaacttcaacagtgagactgtacctcaaaaaagcagccttgaagagccggacttctacaaaaccaagatcaaactctgcattttacttcatgccttccgcatccgggcggtcaccattgaccgtgtcatgtcctacttaaatgcctcg

SEQ ID NO: 18 - DNA, 1596 bp, Artificial Sequence
  Synthetic: hIL12AB_014 ORF
atgtgccaccagcagcttgtgatttcttggttctctcttgtgttccttgcttctcctcttgtggctatttgggagttaaaaaaggacgtgtacgtggtggagcttgactggtaccctgatgctcctggcgagatggtggtgcttacttgtgacactcctgaggaggacggcattacttggactcttgaccagtcttctgaggtgcttggctctggcaagactcttactattcaggtgaaggagttcggggatgctggccagtacacttgccacaagggcggcgaggtgctttctcactctcttcttcttcttcacaagaaggaggacggcatttggtctactgacattttaaaagaccagaaggagcccaagaacaagactttccttcgttgcgaggccaagaactactctggccgtttcacttgctggtggcttactactatttctactgaccttactttctctgtgaagtcttctcgtggctcttctgaccctcagggcgtgacttgtggggctgctactctttctgctgagcgtgtgcgtggggacaacaaggagtacgagtactctgtggagtgccaggaggactctgcttgccctgctgctgaggagtctcttcctattgaggtgatggtggatgctgtgcacaagttaaaatacgagaactacacttcttctttcttcattcgtgacattattaagcctgaccctcccaagaaccttcagttaaaacctttaaaaaactctcgtcaggtggaggtgtcttgggagtaccctgacacttggtctactcctcactcttacttctctcttactttctgcgtgcaggtgcagggcaagtctaagcgtgagaagaaggaccgtgtgttcactgacaagacttctgctactgtgatttgcaggaagaatgcatctatttctgtgcgtgctcaggaccgttactactcttcttcttggtctgagtgggcttctgtgccttgctctggcggcggcggcggcggctctagaaatcttcctgtggctactcctgaccctggcatgttcccttgccttcaccactctcagaaccttcttcgtgctgtgagcaacatgcttcagaaggctcgtcagactcttgagttctacccttgcacttctgaggagattgaccacgaggacatcaccaaggacaagacttctactgtggaggcttgccttcctcttgagcttaccaagaatgaatcttgcttaaattctcgtgagacttctttcatcaccaacggctcttgccttgcctcgcgcaagacttctttcatgatggctctttgcctttcttctatttacgaggacttaaaaatgtaccaggtggagttcaagactatgaatgcaaagcttcttatggaccccaagcgtcagattttccttgaccagaacatgcttgctgtgattgacgagcttatgcaggctttaaatttcaactctgagactgtgcctcagaagtcttctcttgaggagcctgacttctacaagaccaagattaagctttgcattcttcttcatgctttccgtattcgtgctgtgactattgaccgtgtgatgtcttacttaaatgcttct

SEQ ID NO: 19 - DNA, 1596 bp, Artificial Sequence
  Synthetic: hIL12AB_015 ORF
atgtgtcaccagcagctggtgatcagctggtttagcctggtgtttctggccagccccctggtggccatatgggaactgaagaaagatgtgtatgtggtagaactggattggtatccggatgcccccggcgaaatggtggtgctgacctgtgacacccccgaagaagatggtatcacctggaccctggaccagagcagcgaggtgctgggcagcggcaaaaccctgaccatccaagtgaaagagtttggcgatgccggccagtacacctgtcacaaaggcggcgaggtgctaagccattcgctgctgctgctgcacaaaaaggaagatggcatctggagcaccgatatcctgaaggaccagaaagaacccaaaaataagacctttctaagatgcgaggccaagaattatagcggccgtttcacctgctggtggctgacgaccatcagcaccgatctgaccttcagcgtgaaaagcagcagaggcagcagcgacccccaaggcgtgacgtgcggcgccgccaccctgagcgccgagagagtgagaggcgacaacaaggagtatgagtacagcgtggagtgccaggaggacagcgcctgccccgccgccgaggagagcctgcccatcgaggtgatggtggatgccgtgcacaagctgaagtatgaaaactacaccagcagcttcttcatcagagacatcatcaaacccgacccccccaagaacctgcagctgaagcccctgaagaatagcagacaggtggaggtgagctgggagtaccccgacacctggagcaccccccatagctacttcagcctgaccttctgcgtgcaggtgcagggcaagagcaagagagaaaagaaagatagagtgttcacggacaagaccagcgccacggtgatctgcagaaaaaatgccagcatcagcgtgagagcccaggacagatactatagcagcagctggagcgaatgggccagcgtgccctgcagcggcggcggcggcggcggcagcagaaacctgcccgtggccacccccgaccccggcatgttcccctgcctgcaccacagccaaaacctgctgagagccgtgagcaacatgctgcagaaggccagacaaaccctggaattttacccctgcaccagcgaagagatcgatcatgaagatatcaccaaagataaaaccagcaccgtggaggcctgtctgcccctggaactgaccaagaatgagagctgcctaaatagcagagagaccagcttcataaccaatggcagctgcctggccagcagaaagaccagctttatgatggccctgtgcctgagcagcatctatgaagacctgaagatgtaccaggtggagttcaagaccatgaatgccaagctgctgatggatcccaagagacagatctttctggatcaaaacatgctggccgtgatcgatgagctgatgcaggccctgaatttcaacagcgagaccgtgccccaaaaaagcagcctggaagaaccggatttttataaaaccaaaatcaagctgtgcatactgctgcatgccttcagaatcagagccgtgaccatcgatagagtgatgagctatctgaatgccagc

SEQ ID NO: 20 - DNA, 1596 bp, Artificial Sequence
  Synthetic: hIL12AB_016 ORF
atgtgccaccagcagctggtcatcagctggttcagcctggtcttcctggccagccccctggtggccatctgggagctgaagaaggatgtttatgttgtggagctggactggtacccagatgcccctggggagatggtggtgctgacctgtgacaccccagaagaggatggcatcacctggaccctggaccagagctcagaagtgctgggcagtggaaaaaccctgaccatccaggtgaaggagtttggagatgctggccagtacacctgccacaagggtggtgaagtgctgagccacagcctgctgctgctgcacaagaaggaggatggcatctggagcacagacatcctgaaggaccagaaggagcccaagaacaagaccttccttcgctgtgaagccaagaactacagtggccgcttcacctgctggtggctgaccaccatcagcacagacctcaccttctcggtgaagagcagcagaggcagctcagacccccagggtgtcacctgtggggcggccacgctgtcggcggagagagttcgaggggacaacaaggagtatgaatactcggtggagtgccaggaggactcggcgtgcccggcggcagaagagagcctgcccatagaagtgatggtggatgctgtgcacaagctgaagtatgaaaactacaccagcagcttcttcatcagagacatcatcaagccagacccgcccaagaacctgcagctgaagcccctgaagaacagcagacaagtggaggtttcctgggagtacccagacacgtggagcaccccccacagctacttcagcctgaccttctgtgtccaggtgcagggcaagagcaagagagagaagaaggacagagtcttcacagacaagacctcggccacggtcatctgcagaaagaatgcctccatctcggttcgagcccaggacagatactacagcagcagctggtcagaatgggcctcggtgccctgcagtggtggcggcggcggcggcagcagaaacctgcctgttgccaccccagaccctgggatgttcccctgcctgcaccacagccagaacttattacgagctgtttctaacatgctgcagaaggccagacaaaccctggagttctacccctgcacctcagaagagattgaccatgaagacatcaccaaggacaagaccagcactgtagaggcctgcctgcccctggagctgaccaagaatgaaagctgcctgaacagcagagagaccagcttcatcaccaatggaagctgcctggccagcagaaagaccagcttcatgatggccctgtgcctgagcagcatctatgaagacctgaagatgtaccaggtggagttcaagaccatgaatgcaaagctgctgatggaccccaagagacaaatatttttggaccagaacatgctggctgtcattgatgagctgatgcaggccctgaacttcaactcagaaactgtaccccagaagagcagcctggaggagccagacttctacaagaccaagatcaagctgtgcatcctgcttcatgctttcagaatcagagctgtcaccattgaccgcgtgatgagctacttaaatgcctcg

SEQ ID NO: 21 - DNA, 1596 bp, Artificial Sequence
  Synthetic: hIL12AB_017 ORF
atgtgccaccagcagctggtaatcagctggttttccctcgtctttctggcatcacccctggtggctatctgggagctgaagaaggacgtgtacgtggtggagctggattggtaccctgacgccccgggggaaatggtggtgttaacatgcgacacgcctgaggaggacggcatcacctggacactggaccagagcagcgaggtgcttgggtctggtaaaactctgactattcaggtgaaagagttcggggatgccggccaatatacttgccacaagggtggcgaggtgctttctcattctctgctcctgctgcacaagaaagaagatggcatttggtctactgatattctgaaagaccagaaggagcccaagaacaagacctttctgagatgcgaggctaaaaactacagcggaagatttacctgctggtggctgaccacaatctcaaccgacctgacattttcagtgaagtccagcagagggagctccgaccctcagggcgtgacctgcggagccgccactctgtccgcagaaagagtgagaggtgataataaggagtacgagtattcagtcgagtgccaagaggactctgcctgcccagccgccgaggagagcctgccaatcgaggtgatggtagatgcggtacacaagctgaagtatgagaactacacatcctccttcttcataagagacattatcaagcctgacccacctaaaaatctgcaactcaagcctttgaaaaattcaagacaggtggaggtgagctgggagtaccctgatacttggagcaccccccatagctacttttcgctgacattctgcgtccaggtgcagggcaagtcaaagagagagaagaaggatcgcgtgttcactgataagacaagcgccacagtgatctgcagaaaaaacgctagcattagcgtcagagcacaggaccggtattactccagctcctggagcgaatgggcatctgtgccctgcagcggtgggggcggaggcggatctagaaacctccccgttgccacacctgatcctggaatgttcccctgtctgcaccacagccagaacctgctgagagcagtgtctaacatgctccagaaggccaggcagaccctggagttttacccctgcaccagcgaggaaatcgatcacgaggacatcaccaaagataaaacctccaccgtggaggcctgcctgcccctggaactgaccaaaaacgagagctgcctgaatagcagggagacctccttcatcaccaacggctcatgccttgccagccggaaaactagcttcatgatggccctgtgcctgtcttcgatctatgaggacctgaaaatgtaccaggtcgaatttaagacgatgaacgcaaagctgctgatggaccccaagcggcagatctttctggaccagaacatgctggcagtcatagatgagttgatgcaggcattaaacttcaacagcgagaccgtgcctcagaagtccagcctcgaggagccagatttttataagaccaagatcaaactatgcatcctgctgcatgctttcaggattagagccgtcaccatcgatcgagtcatgtcttacctgaatgctagc

SEQ ID NO: 22 - DNA, 1596 bp, Artificial Sequence
  Synthetic: hIL12AB_018 ORF
atgtgtcaccaacagttagtaatctcctggttttctctggtgtttctggccagccccctcgtggccatctgggagcttaaaaaggatgtgtacgtggtggagctggactggtatcccgatgcaccaggcgaaatggtcgtgctgacctgcgatacccctgaagaagatggcatcacctggactctggaccagtcttccgaggtgcttggatctggcaagactctgacaatacaagttaaggagttcggggacgcaggacagtacacctgccacaaaggcggcgaggtcctgagtcactccctgttactgctccacaagaaagaggacggcatttggtccaccgacattctgaaggaccagaaggagcctaagaataaaactttcctgagatgcgaggcaaaaaactatagcggccgctttacttgctggtggcttacaacaatctctaccgatttaactttctccgtgaagtctagcagaggatcctctgacccgcaaggagtgacttgcggagccgccaccttgagcgccgaaagagtccgtggcgataacaaagaatacgagtactccgtggagtgccaggaagattccgcctgcccagctgccgaggagtccctgcccattgaagtgatggtggatgccgtccacaagctgaagtacgaaaactataccagcagcttcttcatccgggatatcattaagcccgaccctcctaaaaacctgcaacttaagcccctaaagaatagtcggcaggttgaggtcagctgggaatatcctgacacatggagcaccccccactcttatttctccctgaccttctgcgtgcaggtgcagggcaagagtaaacgggagaaaaaggacagggtctttaccgataaaaccagcgctacggttatctgtcggaagaacgcttccatctccgtccgcgctcaggatcgttactactcgtcctcatggagcgagtgggccagcgtgccctgcagcggcggcggtggaggcggatccagaaatctgcctgttgccacaccagaccctggcatgttcccctgtctgcatcatagccagaacctgctcagagccgtgagcaacatgctccagaaggccaggcagacattggagttctacccgtgtacatctgaggaaatcgatcacgaagatataaccaaggacaaaacctctacagtagaggcttgtttgcccctggagttgaccaaaaacgagagttgcctgaacagtcgcgagacaagcttcattactaacggcagctgtctcgcctccagaaagacatccttcatgatggccctgtgtctttccagcatatacgaagacctgaaaatgtaccaggtcgagttcaaaacaatgaacgccaagctgcttatggaccccaagagacagatcttcctcgaccaaaacatgctcgctgtgatcgatgagctgatgcaggctctcaacttcaattccgaaacagtgccacagaagtccagtctggaagaacccgacttctacaagaccaagattaagctgtgtattttgctgcatgcgtttagaatcagagccgtgaccattgatcgggtgatgagctacctgaacgcctcg

SEQ ID NO: 23 - DNA, 1596 bp, Artificial Sequence
  Synthetic: hIL12AB_019 ORF
atgtgccaccagcagcttgtcatctcctggttttctcttgtcttcctggcctcgccgctggtggccatctgggagctgaagaaagatgtctatgttgtagagctggactggtacccagatgctcctggagaaatggtggttctcacctgtgacactcctgaagaagatggcatcacctggacgctggaccaaagctcagaagttcttggcagtggaaaaacgctgaccatacaagtaaaagaatttggggatgctggccagtacacgtgccacaaaggaggagaagttctcagccacagtttacttcttcttcacaagaaagaagatggcatctggtccacggacattttaaaagaccagaaggagcccaagaacaaaaccttcctccgctgtgaggccaagaactacagtggtcgtttcacctgctggtggctcaccaccatctccactgacctcaccttctctgtaaaaagcagccgtggttcttctgacccccaaggagtcacctgtggggctgccacgctctcggcagaaagagttcgaggggacaacaaggaatatgaatattctgtggaatgtcaagaagattctgcctgcccggcggcagaagaaagtcttcccatagaagtcatggtggatgctgttcacaaattaaaatatgaaaactacaccagcagcttcttcattcgtgacatcatcaaaccagacccgcccaagaaccttcagttaaaacctttaaaaaacagcagacaagtagaagtttcctgggagtacccggacacgtggtccacgccgcactcctacttcagtttaaccttctgtgtacaagtacaaggaaaatcaaaaagagagaagaaagatcgtgtcttcactgacaaaacatctgccacggtcatctgcaggaagaatgcctccatctcggttcgagcccaggaccgctactacagcagcagctggagtgagtgggcatctgttccctgcagtggtggcggcggcggcggcagccgcaaccttcctgtggccacgccggaccctggcatgttcccgtgccttcaccactcccaaaatcttcttcgtgctgtttctaacatgctgcagaaggcgcgccaaactttagaattctacccgtgcacttctgaagaaatagaccatgaagacatcaccaaagataaaaccagcacggtggaggcctgccttcctttagagctgaccaagaatgaatcctgcctcaacagcagagagaccagcttcatcaccaatggcagctgcctggcctcgcgcaagaccagcttcatgatggcgctgtgcctttcttccatctatgaagatttaaagatgtaccaagtagaatttaaaaccatgaatgccaaattattaatggaccccaaaagacaaatatttttggatcaaaacatgctggctgtcattgatgagctcatgcaagcattaaacttcaactcagaaactgttccccagaagtcatctttagaagagccggacttctacaaaacaaaaataaaactctgcattcttcttcatgccttccgcatccgtgctgtcaccattgaccgtgtcatgtcctacttaaatgcttct

SEQ ID NO: 24 - DNA, 1596 bp, Artificial Sequence
  Synthetic: hIL12AB_020 ORF
atgtgccaccagcagctggtgatcagctggttcagcctggtgttcctggctagccctctggtggccatctgggagctgaagaaggacgtgtacgtggtggagttagactggtaccccgacgctcccggcgagatggtggtgctgacctgcgacacccccgaggaggacgggatcacctggaccctggatcagtcaagcgaggtgctgggaagcggcaagaccctgaccatccaggtgaaggagttcggcgacgccggccaatacacttgccacaagggaggcgaggtgctgtcccactccctcctgctgctgcacaaaaaggaagacggcatctggagcaccgacatcctgaaagaccagaaggagcctaagaacaagacattcctcagatgcgaggccaagaattactccgggagattcacctgttggtggctgaccaccatcagcacagacctgaccttcagcgtgaagagcagcagaggcagcagcgacccccagggcgtgacctgtggcgccgccaccctgagcgccgaaagagtgcgcggcgacaacaaggagtacgagtactccgtggaatgccaggaggacagcgcctgccccgccgccgaggagagcctgcccatcgaggtgatggtggacgccgtccacaagctgaagtacgagaactacacctctagcttcttcatccgggacatcatcaagcccgatccccccaagaacctgcagctgaaacccctgaagaacagcagacaggtggaggtgagctgggagtatcccgacacctggtccaccccccacagctattttagcctgaccttctgcgtgcaagtgcagggcaagagcaagagagagaagaaggaccgcgtgttcaccgacaaaaccagcgccaccgtgatctgcagaaagaacgccagcatcagcgtgagggcccaggatagatactacagttccagctggagcgagtgggccagcgtgccctgcagcggcggcggcgggggaggctctagaaacctgcccgtggctacccccgatcccggaatgttcccctgcctgcaccacagccagaacctgctgagggcggtgtccaacatgcttcagaaggcccggcagaccctggagttctacccctgtacctctgaggagatcgatcatgaggacatcacaaaggacaaaaccagcaccgtggaggcctgcctgcccctggagctgaccaagaacgagagctgcctgaactcccgcgagaccagcttcatcacgaacggcagctgcctggccagcaggaagacctccttcatgatggccctgtgcctgagcagcatctacgaggacctgaaaatgtaccaggtggagtttaagaccatgaacgccaagctgctgatggaccccaagcggcaaatcttcctggaccagaacatgctggcagtgatcgacgagctcatgcaggccctgaacttcaatagcgagacagtcccccagaagagcagcctggaggagcccgacttttacaagaccaagatcaagctgtgcatcctgctgcacgcctttagaatccgtgccgtgaccattgacagagtgatgagctacctgaatgccagc

SEQ ID NO: 25 - DNA, 1596 bp, Artificial Sequence
  Synthetic: hIL12AB_021 ORF
atgtgccaccagcagctggtgatcagctggttcagcctggtgttcctggccagccctctggttgccatctgggagctgaagaaagacgtgtacgtcgtggaactggactggtatccggacgccccgggcgagatggtggtgctgacctgtgacacccccgaggaggacggcatcacctggacgctggaccaatcctccgaggtgctgggaagcggcaagaccctgaccatccaggtgaaggaattcggggacgccgggcagtacacctgccacaaggggggcgaagtgctgtcccactcgctgctgctcctgcataagaaggaggatggaatctggtccaccgacatcctcaaagatcagaaggagcccaagaacaagacgttcctgcgctgtgaagccaagaattattcggggcgattcacgtgctggtggctgacaaccatcagcaccgacctgacgtttagcgtgaagagcagcagggggtccagcgacccccagggcgtgacgtgcggcgccgccaccctctccgccgagagggtgcggggggacaataaggagtacgagtacagcgtggaatgccaggaggacagcgcctgccccgccgcggaggaaagcctcccgatagaggtgatggtggacgccgtgcacaagctcaagtatgagaattacaccagcagctttttcatccgggacattatcaagcccgaccccccgaagaacctccagctgaagcccctgaagaacagccggcaggtggaagtctcctgggagtatcccgacacctggagcaccccgcacagctacttctccctgaccttctgtgtgcaggtgcagggcaagtccaagagggaaaagaaggacagggttttcaccgacaagaccagcgcgaccgtgatctgccggaagaacgccagcataagcgtccgcgcccaagataggtactacagcagctcctggagcgagtgggctagcgtgccctgcagcgggggcgggggtgggggctccaggaacctgccagtggcgacccccgaccccggcatgttcccctgcctccatcacagccagaacctgctgagggccgtcagcaatatgctgcagaaggccaggcagaccctggaattctacccctgcacgtcggaggagatcgatcacgaggatatcacaaaagacaagacttccaccgtggaggcctgcctgcccctggagctcaccaagaatgagtcctgtctgaactcccgggaaaccagcttcatcaccaacgggtcctgcctggccagcaggaagaccagctttatgatggccctgtgcctgtcgagcatctacgaggacctgaagatgtaccaggtcgagttcaagacaatgaacgccaagctgctgatggaccccaagaggcaaatcttcctggaccagaatatgcttgccgtcatcgacgagctcatgcaggccctgaacttcaactccgagaccgtgccccagaagagcagcctggaggagcccgacttctacaagaccaagatcaagctgtgcatcctgctgcacgcgttcaggatccgggcagtcaccatcgaccgtgtgatgtcctacctgaacgccagc

SEQ ID NO: 26 - DNA, 1596 bp, Artificial Sequence
  Synthetic: hIL12AB_022 ORF
atgtgccatcagcagctggtgatcagctggttcagcctggtgttcctcgcctctcccctggtggccatctgggagctcaaaaaggacgtgtacgtggtggagctcgactggtacccagacgcccccggggagatggtggtgctgacctgcgacacccccgaagaagacggcatcacgtggaccctcgaccagtccagcgaggtgctggggagcgggaagactctgaccatccaggtcaaggagttcggggacgccgggcagtacacgtgccacaagggcggcgaagtcttaagccacagcctgctcctgctgcacaagaaggaggacgggatctggtccacagacatactgaaggaccagaaggagccgaagaataaaacctttctgaggtgcgaggccaagaactattccggcaggttcacgtgctggtggcttacaacaatcagcacagacctgacgttcagcgtgaagtccagccgcggcagcagcgacccccagggggtgacctgcggcgccgccaccctgagcgccgagcgggtgcgcggggacaacaaggagtacgagtactccgtggagtgccaggaagacagcgcctgtcccgccgccgaagagagcctgcctatcgaggtcatggtagatgcagtgcataagctgaagtacgagaactatacgagcagctttttcatacgcgacatcatcaagcccgacccccccaagaacctgcagcttaagcccctgaagaatagccggcaggtggaggtctcctgggagtaccccgacacctggtcaacgccccacagctacttctccctgaccttttgtgtccaagtccagggaaagagcaagagggagaagaaagatcgggtgttcaccgacaagacctccgccacggtgatctgcaggaagaacgccagcatctccgtgagggcgcaagacaggtactactccagcagctggtccgaatgggccagcgtgccctgctccggcggcgggggcggcggcagccgaaacctacccgtggccacgccggatcccggcatgtttccctgcctgcaccacagccagaacctcctgagggccgtgtccaacatgctgcagaaggccaggcagactctggagttctacccctgcacgagcgaggagatcgatcacgaggacatcaccaaggataagaccagcactgtggaggcctgccttcccctggagctgaccaagaacgagagctgtctgaactccagggagacctcattcatcaccaacggctcctgcctggccagcaggaaaaccagcttcatgatggccttgtgtctcagctccatctacgaggacctgaagatgtatcaggtcgagttcaagacaatgaacgccaagctgctgatggaccccaaaaggcagatcttcctggaccagaacatgctggccgtcatcgacgagctgatgcaggccctgaacttcaacagcgagacggtgccccagaaaagctccctggaggagcccgacttctacaagaccaagatcaagctgtgcatcctgctgcacgccttcaggatcagggcagtgaccatcgaccgggtgatgtcataccttaacgccagc

SEQ ID NO: 27 - DNA, 1596 bp, Artificial Sequence
  Synthetic: hIL12AB_023 ORF
atgtgccatcagcagctggtgatctcctggttcagcctggtgtttctggcctcgcccctggtcgccatctgggagctgaagaaagacgtgtacgtcgtcgaactggactggtaccccgacgcccccggggagatggtggtgctgacctgcgacacgccggaggaggacggcatcacctggaccctggatcaaagcagcgaggtgctgggcagcggcaagaccctgaccatccaagtgaaggaattcggcgatgccggccagtacacctgtcacaaagggggcgaggtgctcagccacagcctgctgctgctgcacaagaaggaggatggcatctggagcaccgatatcctgaaggaccagaaagagcccaagaacaagacgttcctgaggtgcgaggccaagaactacagcggtaggttcacgtgttggtggctgaccaccatcagcaccgacctgacgttcagcgtgaagagctccaggggcagctccgacccacagggggtgacgtgcggggccgcaaccctcagcgccgaaagggtgcggggggacaacaaggagtacgaatactccgtggagtgccaggaagattcggcctgccccgccgcggaggagagcctccccatcgaggtaatggtggacgccgtgcataagctgaagtacgagaactacaccagctcgttcttcatccgagacatcatcaaacccgacccgcccaaaaatctgcagctcaagcccctgaagaactccaggcaggtggaggtgagctgggagtaccccgacacctggtccaccccgcacagctacttctccctgacattctgcgtgcaggtgcagggcaagagcaagcgggagaagaaggacagggtgttcaccgacaagacgagcgccaccgtgatctgccgaaagaacgccagcatctcggtgcgcgcccaggataggtactattccagctcctggagcgagtgggcctcggtaccctgcagcggcggcgggggcggcggcagtaggaatctgcccgtggctaccccggacccgggcatgttcccctgcctccaccacagccagaacctgctgagggccgtgagcaacatgctgcagaaggccagacagacgctggagttctacccctgcacgagcgaggagatcgaccacgaggacatcaccaaggataaaacttccaccgtcgaggcctgcctgcccttggagctgaccaagaatgaatcctgtctgaacagcagggagacctcgtttatcaccaatggcagctgcctcgcctccaggaagaccagcttcatgatggccctctgtctgagctccatctatgaggacctgaagatgtaccaggtggagttcaagaccatgaacgcgaagctgctgatggaccccaagaggcagatcttcctggatcagaatatgctggcggtgatcgacgagctcatgcaggccctcaatttcaatagcgagacagtgccccagaagtcctccctggaggagcccgacttctacaagaccaagatcaagctgtgtatcctgctgcacgccttccggatccgggccgtcaccatcgaccgggtcatgagctacctcaatgccagc

SEQ ID NO: 28 - DNA, 1596 bp, Artificial Sequence
  Synthetic: hIL12AB_024 ORF
atgtgccaccagcagctggtgatctcctggttctccctggtgttcctggcctcgcccctggtggccatctgggagctgaagaaggacgtgtacgtcgtggagctcgactggtaccccgacgcccctggcgagatggtggtgctgacctgcgacaccccagaggaggatggcatcacctggaccctggatcagtcctccgaggtgctgggctccggcaagacgctgaccatccaagtgaaggagttcggtgacgccggacagtatacctgccataagggcggcgaggtcctgtcccacagcctcctcctcctgcataagaaggaggacggcatctggagcaccgacatcctgaaggaccagaaggagcccaagaacaagacctttctgaggtgcgaggccaagaactacagcggccgattcacctgctggtggctcaccaccatatccaccgacctgactttctccgtcaagtcctcccgggggtccagcgacccccagggagtgacctgcggcgccgccaccctcagcgccgagcgggtgcggggggacaacaaggagtacgaatactccgtcgagtgccaggaggactccgcctgcccggccgccgaggagagcctgcccatcgaggtgatggtcgacgcggtgcacaagctgaagtacgagaactacaccagcagtttcttcatcagggatatcatcaagccagatcccccgaagaatctgcaactgaagccgctgaaaaactcacgacaggtggaggtgagctgggagtaccccgacacgtggagcaccccacattcctacttcagcctgaccttctgcgtgcaggtccagggcaagagcaagcgggagaagaaggacagggtgttcacggataagaccagtgccaccgtgatctgcaggaagaacgcctctattagcgtgagggcccaggatcggtattactcctcgagctggagcgaatgggcctccgtgccctgcagtggggggggtggaggcgggagcaggaacctgcccgtagcaacccccgaccccgggatgttcccctgtctgcaccactcgcagaacctgctgcgcgcggtgagcaacatgctccaaaaagcccgtcagaccttagagttctacccctgcaccagcgaagaaatcgaccacgaagacatcaccaaggacaaaaccagcaccgtggaggcgtgcctgccgctggagctgaccaagaacgagagctgcctcaactccagggagaccagctttatcaccaacggctcgtgcctagccagccggaaaaccagcttcatgatggccctgtgcctgagctccatttacgaggacctgaagatgtatcaggtggagttcaagaccatgaatgccaaactcctgatggaccccaagaggcagatcttcctggaccagaacatgctcgcggtgatcgatgagctgatgcaggccctgaactttaatagcgagaccgtgccccagaaaagcagcctggaggagccggacttctacaagaccaaaatcaagctgtgcatcctgctccacgccttccgcatccgggccgtgaccatcgacagggtgatgagctacctgaacgccagc

SEQ ID NO: 29 - DNA, 1596 bp, Artificial Sequence
  Synthetic: hIL12AB_025 ORF
atgtgccatcagcagctggtgatttcctggttctccctggtgttcctggccagccccctcgtggcgatctgggagctaaagaaggacgtgtacgtggtggagctggactggtacccggacgcacccggcgagatggtcgttctgacctgcgatacgccagaggaggacggcatcacctggaccctcgatcagagcagcgaggtcctggggagcggaaagaccctgaccatccaggtcaaggagttcggcgacgccggccagtacacctgccacaaaggtggcgaggtcctgagccactcgctgctgctcctgcataagaaggaggacggaatctggagcacagacatcctgaaagaccagaaggagcccaagaacaagaccttcctgaggtgcgaggccaagaactacagcgggcgcttcacgtgctggtggctgaccaccatcagcacggacctcaccttctccgtgaagagcagccggggatccagcgatccccaaggcgtcacctgcggcgcggccaccctgagcgcggagagggtcaggggcgataataaggagtatgagtacagcgtggagtgccaggaggacagcgcctgcccggccgccgaggagtccctgccaatcgaagtgatggtcgacgccgtgcacaagctgaagtacgagaactacaccagcagcttcttcatccgggatatcatcaagcccgatcccccgaagaacctgcagctgaagcccctcaagaacagccggcaggtggaggtgagttgggagtaccccgacacctggtcaacgccccacagctacttctccctgaccttctgtgtgcaggtgcagggaaagagcaagagggagaagaaagaccgggtcttcaccgacaagaccagcgccacggtgatctgcaggaagaacgcaagcatctccgtgagggcccaggacaggtactacagctccagctggtccgaatgggccagcgtgccctgtagcggcggcgggggcggtggcagccgcaacctcccagtggccacccccgaccccggcatgttcccctgcctgcaccacagccagaatctgctgagggccgtgagtaacatgctgcagaaggcaaggcaaaccctcgaattctatccctgcacctccgaggagatcgaccacgaggatatcaccaaggacaagaccagcaccgtcgaggcctgtctccccctggagctgaccaagaatgagagctgcctgaacagccgggagaccagcttcatcaccaacgggagctgcctggcctccaggaagacctcgttcatgatggcgctgtgcctctcaagcatatacgaggatctgaagatgtaccaggtggagtttaagacgatgaacgccaagctgctgatggacccgaagaggcagatcttcctggaccagaacatgctggccgtgatagacgagctcatgcaggccctgaacttcaactccgagaccgtgccgcagaagtcatccctcgaggagcccgacttctataagaccaagatcaagctgtgcatcctgctccacgccttccggataagggccgtgacgatcgacagggtgatgagctaccttaacgccagc

SEQ ID NO: 30 - DNA, 1596 bp, Artificial Sequence
  Synthetic: hIL12AB_026 ORF
atgtgccaccagcagctcgtgatcagctggttctccctggtgtttctcgccagccccctggtggccatctgggagctgaagaaggacgtgtacgtggtggagctggactggtaccctgacgccccgggggagatggtcgtgctgacctgcgacacccccgaagaggacggtatcacctggaccctggaccagtccagcgaggtgctgggcagcggcaagaccctgactattcaagtcaaggagttcggagacgccggccagtacacctgccacaagggtggagaggtgttatcacacagcctgctgctgctgcacaagaaggaagacgggatctggagcaccgacatcctgaaggaccagaaggagcccaaaaacaagaccttcctgcggtgcgaggccaagaactattcgggccgctttacgtgctggtggctgaccaccatcagcactgatctcaccttcagcgtgaagtcctcccgggggtcgtccgacccccagggggtgacctgcggggccgccaccctgtccgccgagagagtgaggggcgataataaggagtacgagtacagcgttgagtgccaggaagatagcgcctgtcccgccgccgaggagagcctgcccatcgaggtgatggtggacgccgtccacaagctgaagtatgagaactacacctcaagcttcttcatcagggacatcatcaaacccgatccgcccaagaatctgcagctgaagcccctgaaaaatagcaggcaggtggaggtgagctgggagtaccccgacacctggtccaccccccatagctatttctccctgacgttctgcgtgcaggtgcaagggaagagcaagcgggagaagaaggaccgggtgttcaccgacaagacctccgccaccgtgatctgtaggaagaacgcgtcgatctcggtcagggcccaggacaggtattacagcagcagctggagcgagtgggcgagcgtgccctgctcgggcggcggcggcggcgggagcagaaatctgcccgtggccaccccagaccccggaatgttcccctgcctgcaccattcgcagaacctcctgagggccgtgagcaacatgctgcagaaggcccgccagacgctggagttctacccctgcacgagcgaggagatcgaccacgaagacatcaccaaggacaaaaccagcaccgtggaggcctgcctgcccctggagctgaccaaaaacgaatcctgcctcaacagccgggagaccagcttcatcaccaacggcagctgcctggccagccgaaagacctccttcatgatggccctctgcctgagcagcatctatgaggatctgaagatgtatcaggtggagttcaagaccatgaatgccaagctgctgatggaccccaagaggcagatattcctggaccagaatatgctggccgtgatcgacgagctgatgcaggccctgaacttcaacagcgagaccgtcccccagaagtccagcctggaggagccggacttttacaaaacgaagatcaagctgtgcatactgctgcacgccttcaggatccgggccgtgacaatcgacagggtgatgtcctacctgaacgccagc

SEQ ID NO: 31 - DNA, 1596 bp, Artificial Sequence
  Synthetic: hIL12AB_027 ORF
atgtgtcaccagcagctggtgatcagctggttctccctggtgttcctggccagccccctggtggccatctgggagctcaagaaggacgtctacgtcgtggagctggattggtaccccgacgctcccggggagatggtggtgctgacctgcgacacccccgaggaggacggcatcacctggacgctggaccagagctcagaggtgctgggaagcggaaagacactgaccatccaggtgaaggagttcggggatgccgggcagtatacctgccacaagggcggcgaagtgctgagccattccctgctgctgctgcacaagaaggaggacggcatatggtccaccgacatcctgaaggatcagaaggagccgaagaataaaaccttcctgaggtgcgaggccaagaattacagcggccgattcacctgctggtggctgaccaccatcagcaccgacctgaccttcagtgtgaagtcctcacggggcagctcagatccccagggcgtgacctgcggggccgcgacactcagcgccgagcgggtgaggggtgataacaaggagtacgagtattctgtggagtgccaggaagactccgcctgtcccgccgccgaggagtccctgcccatcgaggtgatggtggacgccgtgcataaactgaagtacgagaactacacctccagcttcttcatccgggatataatcaagcccgaccctccgaaaaacctgcagctgaagccccttaaaaacagccggcaggtggaggtgagctgggagtaccccgacacctggagcaccccccatagctatttcagcctgaccttctgcgtgcaggtgcaggggaagtccaagcgcgagaaaaaggaccgggtgttcaccgacaagacgagcgccaccgtgatctgccggaagaacgccagtataagcgtaagggcccaggataggtactacagctccagctggtcggagtgggcctccgtgccctgttccggcggcggggggggtggcagcaggaacctccccgtggccacgccggaccccggcatgttcccgtgcctgcaccactcccaaaacctcctgcgggccgtcagcaacatgctgcaaaaggcgcggcagaccctggagttttacccctgtacctccgaagagatcgaccacgaggatatcaccaaggataagacctccaccgtggaggcctgtctccccctggagctgaccaagaacgagagctgtcttaacagcagagagacctcgttcataacgaacggctcctgcctcgcttccaggaagacgtcgttcatgatggcgctgtgcctgtccagcatctacgaggacctgaagatgtatcaggtcgagttcaaaaccatgaacgccaagctgctgatggaccccaagaggcagatcttcctggaccagaacatgctcgccgtgatcgacgagctgatgcaggccctgaacttcaacagcgaaaccgtgccccagaagtcaagcctggaggagccggacttctataagaccaagatcaagctgtgtatcctgctacacgcttttcgtatccgggccgtgaccatcgacagggttatgtcgtacttgaacgccagc

SEQ ID NO: 32 - DNA, 1596 bp, Artificial Sequence
  Synthetic: hIL12AB_028 ORF
atgtgccaccaacagctcgtgatcagctggttcagcctggtgttcctggccagcccgctggtggccatctgggagctgaagaaggacgtgtacgtggtggagctggactggtaccccgacgcccccggcgagatggtggtcctgacctgcgacacgccggaagaggacggcatcacctggaccctggatcagtccagcgaggtgctgggctccggcaagaccctgaccattcaggtgaaggagttcggcgacgccggtcagtacacctgccacaagggcggcgaggtgctgagccacagcctactgctcctgcacaaaaaggaggatggaatctggtccaccgacatcctcaaggaccagaaggagccgaagaacaagacgttcctccggtgcgaggccaagaactacagcggcaggtttacctgctggtggctgaccaccatcagcaccgacctgacattttccgtgaagagcagccgcggcagcagcgatccccagggcgtgacctgcggggcggccaccctgtccgccgagcgtgtgaggggcgacaacaaggagtacgagtacagcgtggaatgccaggaggacagcgcctgtcccgccgccgaggagagcctgccaatcgaggtcatggtggacgccgtgcacaagctgaagtacgagaactacacgagcagcttcttcatcagggacatcatcaaaccggacccgcccaagaacctgcagctgaaacccttgaaaaacagcaggcaggtggaagtgtcttgggagtaccccgacacctggtccaccccccacagctactttagcctgaccttctgtgtgcaggtccagggcaagtccaagagggagaagaaggacagggtgttcaccgacaaaaccagcgccaccgtgatctgcaggaagaacgcctccatcagcgtgcgggcccaggacaggtattacagctcgtcgtggagcgagtgggccagcgtgccctgctccgggggaggcggcggcggaagccggaatctgcccgtggccacccccgatcccggcatgttcccgtgtctgcaccacagccagaacctgctgcgggccgtgagcaacatgctgcagaaggcccgccaaaccctggagttctacccctgtacaagcgaggagatcgaccatgaggacattaccaaggacaagaccagcaccgtggaggcctgcctgcccctcgagctcacaaagaacgaatcctgcctgaatagccgcgagaccagctttatcacgaacgggtcctgcctcgccagccggaagacaagcttcatgatggccctgtgcctgagcagcatctacgaggacctgaaaatgtaccaagtggagttcaaaacgatgaacgccaagctgctgatggaccccaagcgccagatcttcctggaccagaacatgctggccgtcatcgacgagctcatgcaggccctgaacttcaacagcgagaccgtgccccagaagagcagcctggaggagcccgacttctacaagacgaagatcaagctctgcatcctgctgcacgctttccgcatccgcgcggtgaccatcgaccgggtgatgagctacctcaacgccagt

SEQ ID NO: 33 - DNA, 1596 bp, Artificial Sequence
  Synthetic: hIL12AB_029 ORF
atgtgccaccaacagctggtgatcagctggttcagcctggtgtttctggcctcccctctggtggccatctgggagctgaagaaggacgtgtacgtggtggagctggactggtaccctgacgcccccggcgaaatggtggtgctgacgtgcgacacccccgaggaggatggcatcacctggaccctggaccaaagcagcgaggtcctcggaagcggcaagaccctcactatccaagtgaaggagttcggggatgcgggccagtacacctgccacaagggcggcgaggtgctgtctcatagcctgctgctcctgcataagaaggaagacggcatctggagcaccgacatactgaaggatcagaaggagcccaagaacaagaccttcctgaggtgcgaggccaagaactactccgggcgcttcacctgttggtggctgaccaccatctccaccgacctgaccttcagcgtgaagagcagcagggggagcagcgacccccagggggtgacctgcggagccgcgaccttgtcggccgagcgggtgaggggcgacaataaggagtacgagtactcggtcgaatgccaggaggactccgcctgccccgccgccgaggagtccctccccatcgaagtgatggtggacgccgtccacaagctgaagtacgagaactacaccagcagcttcttcatacgggatatcatcaagcccgaccccccgaagaacctgcagctgaaacccttgaagaactccaggcaggtggaggtgagctgggagtaccccgacacctggtccaccccgcactcatacttcagcctgaccttctgtgtacaggtccagggcaagagcaagagggaaaagaaggatagggtgttcaccgacaagacctccgccacggtgatctgtcggaaaaacgccagcatctccgtgcgggcccaggacaggtactattccagcagctggagcgagtgggcctccgtcccctgctccggcggcggtggcgggggcagcaggaacctccccgtggccacccccgatcccgggatgttcccatgcctgcaccacagccaaaacctgctgagggccgtctccaatatgctgcagaaggcgaggcagaccctggagttctacccctgtacctccgaggagatcgaccacgaggatatcaccaaggacaagacctccacggtcgaggcgtgcctgcccctggagctcacgaagaacgagagctgccttaactccagggaaacctcgtttatcacgaacggcagctgcctggcgtcacggaagacctcctttatgatggccctatgtctgtcctcgatctacgaggacctgaagatgtaccaggtggagttcaagaccatgaacgccaagctgctgatggatcccaagaggcagattttcctggaccagaacatgctggccgtgattgacgagctgatgcaggcgctgaacttcaacagcgagacagtgccgcagaagagctccctggaggagccggacttttacaagaccaagataaagctgtgcatcctgctccacgccttcagaatacgggccgtcaccatcgatagggtgatgtcttacctgaacgcctcc

SEQ ID NO: 34 - DNA, 1596 bp, Artificial Sequence
  Synthetic: hIL12AB_030 ORF
atgtgccaccagcagctggtgattagctggtttagcctggtgttcctggcaagccccctggtggccatctgggaactgaaaaaggacgtgtacgtggtcgagctggattggtaccccgacgcccccggcgaaatggtggtgctgacgtgtgatacccccgaggaggacgggatcacctggaccctggatcagagcagcgaggtgctggggagcgggaagaccctgacgatccaggtcaaggagttcggcgacgctgggcagtacacctgtcacaagggcggggaggtgctgtcccactccctgctgctcctgcataagaaagaggacggcatctggtccaccgacatcctcaaggaccagaaggagcccaagaacaagaccttcctgcggtgtgaggcgaagaactacagcggccgtttcacctgctggtggctgacgacaatcagcaccgacttgacgttctccgtgaagtcctccagaggcagctccgacccccaaggggtgacgtgcggcgcggccaccctgagcgccgagcgggtgcggggggacaacaaggagtacgagtactccgtggagtgccaggaggacagcgcctgtcccgcagccgaggagtccctgcccatcgaagtcatggtggacgccgtccacaagctgaagtacgagaactacaccagcagcttcttcatccgcgatatcatcaagcccgatccccccaaaaacctgcaactgaagccgctgaagaatagcaggcaggtggaggtgtcctgggagtacccggacacctggagcacgccccacagctatttcagcctgaccttttgcgtgcaggtccaggggaagagcaagcgggagaagaaggaccgcgtgtttacggacaaaaccagcgccaccgtgatctgcaggaagaacgccagcatcagcgtgagggcccaggacaggtactacagcagctcctggagcgagtgggcctccgtgccctgttccggaggcggcgggggcggttcccggaacctcccggtggccacccccgacccgggcatgttcccgtgcctgcaccactcacagaatctgctgagggccgtgagcaatatgctgcagaaggcaaggcagaccctggagttttatccctgcaccagcgaggagatcgaccacgaagacatcaccaaggacaagaccagcacagtggaggcctgcctgcccctggaactgaccaagaacgagtcctgtctgaactcccgggaaaccagcttcataaccaacggctcctgtctcgccagcaggaagaccagcttcatgatggccctgtgcctcagctccatctacgaggacctcaagatgtaccaggttgagttcaagaccatgaacgccaagctcctgatggaccccaagaggcagatcttcctggaccagaatatgctggccgtgatcgatgagttaatgcaggcgctgaacttcaacagcgagacggtgccccaaaagtcctcgctggaggagcccgacttctacaagaccaagatcaagctgtgcatcctcctgcacgccttccgaatccgggccgtaaccatcgacagggtgatgagctatctcaacgcctcc

SEQ ID NO: 35 - DNA, 1596 bp, Artificial Sequence
  Synthetic: hIL12AB_031 ORF
atgtgccaccagcagctcgtgatcagctggttctcgcttgtgttcctggcctcccccctcgtcgccatctgggagctgaagaaagacgtgtacgtggtggagctggactggtatcccgacgccccgggggagatggtggtgctgacctgcgacaccccggaagaggacggcatcacctggacgctcgaccagtcgtccgaagtgctggggtcgggcaagaccctcaccatccaggtgaaggagttcggagacgccggccagtacacctgtcataaggggggggaggtgctgagccacagcctcctgctcctgcacaaaaaggaggacggcatctggagcaccgatatcctcaaggaccagaaggagcccaagaacaagacgttcctgaggtgtgaggccaagaactacagcgggcggttcacgtgttggtggctcaccaccatctccaccgacctcaccttctccgtgaagtcaagcaggggcagctccgacccccaaggcgtcacctgcggcgccgccaccctgagcgccgagagggtcaggggggataacaaggaatacgagtacagtgtggagtgccaagaggatagcgcctgtcccgccgccgaagagagcctgcccatcgaagtgatggtggacgccgtgcacaagctgaagtacgagaactacacctccagcttcttcatcagggatatcatcaagcccgatccccccaagaacctgcagctgaagcccctgaagaacagcaggcaggtggaggtgagctgggagtatcccgacacgtggagcaccccgcacagctacttctcgctgaccttctgcgtgcaggtgcaagggaagtccaagagggagaagaaggatagggtgttcaccgacaaaacgagcgccaccgtgatctgccggaagaatgccagcatctctgtgagggcccaggacaggtactattccagctcctggtcggagtgggccagcgtgccctgtagcggcgggggcgggggcggcagcaggaacctcccggttgccacccccgaccccggcatgtttccgtgcctgcaccactcgcaaaacctgctgcgcgcggtctccaacatgctgcaaaaagcgcgccagacgctggagttctacccctgcaccagcgaggagatcgatcatgaagatatcaccaaagacaagacctcgaccgtggaggcctgcctgcccctggagctcaccaagaacgaaagctgcctgaacagcagggagacaagcttcatcaccaacggcagctgcctggcctcccggaagaccagcttcatgatggccctgtgcctgtccagcatctacgaggatctgaagatgtaccaagtggagtttaagaccatgaacgccaagctgttaatggaccccaaaaggcagatcttcctggatcagaacatgctggccgtcatcgacgagctgatgcaagccctgaacttcaacagcgagacggtgccccagaagagcagcctcgaggagcccgacttctataagaccaagataaagctgtgcattctgctgcacgccttcagaatcagggccgtgaccatcgatagggtgatgagctacctgaacgccagc

SEQ ID NO: 36 - DNA, 1596 bp, Artificial Sequence
  Synthetic: hIL12AB_032 ORF
atgtgtcaccagcagctggtgatttcctggttcagtctggtgtttcttgccagccccctggtggccatctgggagctgaagaaagacgtatacgtcgtggagctggactggtatcccgacgctcccggcgagatggtggtcctcacctgcgacaccccagaggaggacggcatcacctggaccctggaccagagctccgaggtcctgggcagcggtaagaccctcaccatccaggtgaaggagtttggtgatgccgggcagtatacctgccacaagggcggcgaggtgctgtcccacagcctcctgttactgcataagaaggaggatggcatctggagcaccgacatcctcaaggaccagaaagagcccaagaacaagacctttctgcggtgcgaggcgaaaaattactccggccggttcacctgctggtggctgaccaccatcagcacggacctgacgttctccgtgaagtcgagcagggggagctccgatccccagggcgtgacctgcggcgcggccaccctgagcgccgagcgcgtccgcggggacaataaggaatacgaatatagcgtggagtgccaggaggacagcgcctgccccgcggccgaggagagcctcccgatcgaggtgatggtggatgccgtccacaagctcaaatacgaaaactacaccagcagcttcttcattagggacatcatcaagcccgacccccccaaaaacctgcagctgaagcccctgaagaacagccgccaggtcgaggtgtcatgggagtacccagacacctggagcaccccccactcctacttcagcctgaccttctgcgtccaggtgcagggaaagtccaaacgggagaagaaggatagggtctttaccgataagacgtcggccaccgtcatctgcaggaagaacgccagcataagcgtgcgggcgcaggatcggtactacagctcgagctggtccgaatgggcctccgtgccctgtagcggagggggtggcgggggcagcaggaacctgcccgtggccaccccggacccgggcatgtttccctgcctgcatcacagtcagaacctgctgagggccgtgagcaacatgctccagaaggcccgccagaccctggagttttacccctgcaccagcgaagagatcgatcacgaagacatcaccaaagacaagacctccaccgtggaggcctgtctgcccctggagctgaccaagaacgagagctgtctgaacagcagggagacctccttcatcaccaacggctcctgcctggcatcccggaagaccagcttcatgatggccctgtgtctgagctctatctacgaggacctgaagatgtaccaggtcgagttcaagaccatgaacgccaagctgctgatggaccccaagcgacagatattcctggaccagaacatgctcgccgtgatcgatgaactgatgcaagccctgaacttcaatagcgagaccgtgccccagaaaagcagcctggaggagcccgacttctacaagaccaagatcaaactgtgcatactgctgcacgcgttcaggatccgggccgtcaccatcgaccgggtgatgtcctatctgaatgccagc

SEQ ID NO: 37 - DNA, 1596 bp, Artificial Sequence
  Synthetic: hIL12AB_033 ORF
atgtgccaccagcagctcgtgattagctggttttcgctggtgttcctggccagccctctcgtggccatctgggagctgaaaaaagacgtgtacgtggtggagctggactggtacccggacgcccccggcgagatggtggtgctgacgtgcgacaccccggaagaggacggcatcacctggaccctggaccagtcatccgaggtcctgggcagcggcaagacgctcaccatccaggtgaaggagttcggcgacgccggccagtacacatgccataagggcggggaggtgctgagccacagcctgctcctcctgcacaagaaggaggatggcatctggtctacagacatcctgaaggaccagaaagagcccaagaacaagaccttcctccggtgcgaggccaagaactactccgggcggtttacttgttggtggctgaccaccatcagcaccgacctcaccttcagcgtgaagagctcccgagggagctccgacccccagggggtcacctgcggcgccgccaccctgagcgccgagcgggtgaggggcgacaacaaggagtatgaatacagcgtggaatgccaagaggacagcgcctgtcccgcggccgaggaaagcctgcccatcgaggtgatggtggacgccgtccacaaactcaagtacgagaactacaccagcagtttcttcattcgcgacatcatcaagccggacccccccaaaaacctgcagctcaaacccctgaagaacagcaggcaggtggaggtcagctgggagtacccggacacctggagcaccccccatagctacttcagcctgaccttctgcgtgcaggtgcagggcaagagcaaacgcgagaagaaggaccgggtgtttaccgacaagaccagcgccacggtgatctgccgaaagaatgcaagcatctccgtgagggcgcaggaccgctactactctagcagctggagcgagtgggccagcgtgccctgcagcggtggcggcggaggcggcagccgtaacctccccgtggccacccccgaccccggcatgttcccgtgtctgcaccactcccagaacctgctgagggccgtcagcaatatgctgcagaaggcccggcagacgctggagttctacccctgcacctccgaggagatcgaccatgaggacattaccaaggacaagacgagcactgtggaggcctgcctgcccctggagctcaccaaaaacgagagctgcctgaatagcagggagacgtccttcatcaccaacggcagctgtctggccagcaggaagaccagcttcatgatggccctgtgcctctcctccatatatgaggatctgaagatgtaccaggtggagttcaagaccatgaacgccaagctgctgatggatcccaagaggcagatcttcctggaccagaatatgctggccgtgattgacgagctgatgcaggccctgaactttaatagcgagaccgtcccccagaagagcagcctggaggagcccgacttctataagaccaagatcaagctgtgcatactgctgcacgcgtttaggataagggccgtcaccatcgacagggtgatgagctacctgaatgccagc

SEQ ID NO: 38 - DNA, 1596 bp, Artificial Sequence
  Synthetic: hIL12AB_034 ORF
atgtgccaccaacagctggtgatctcctggttcagcctggtgttcctcgccagccccctggtggccatctgggagctgaagaaagacgtgtacgtggtggagctggactggtatcccgacgcccccggcgagatggtcgtgctgacctgcgacaccccggaggaggacggcatcacctggaccctggatcagtcctccgaggtgctgggcagcgggaagaccctgaccatccaggtgaaagagttcggagatgccggccagtatacctgtcacaaggggggtgaggtgctgagccatagcctcttgcttctgcacaagaaggaggacggcatctggtccaccgacatcctcaaggaccaaaaggagccgaagaataaaacgttcctgaggtgcgaagccaagaactattccggacggttcacctgctggtggctgaccaccatcagcaccgacctcaccttctccgtaaagtcaagcaggggcagctccgacccccagggcgtgacctgcggagccgccaccctgagcgcagagagggtgaggggcgacaacaaggagtacgaatactccgtcgagtgccaggaggacagcgcctgccccgccgccgaggaaagtctgcccatcgaggtgatggtggacgccgtgcacaagctcaaatacgagaactacaccagcagcttcttcatccgggatatcatcaagcccgaccctccaaagaatctgcagctgaaaccccttaagaacagcaggcaggtggaggtcagctgggagtaccccgacacctggagcacgccccactcctactttagcctgaccttttgcgtgcaggtgcaggggaaaagcaagcgggagaagaaggacagggtgttcaccgataagacctccgctaccgtgatctgcaggaagaacgcctcaatcagcgtgagggcccaggatcggtactactccagctcctggagcgagtgggccagcgtgccctgctctggcggtggcggcgggggcagccggaacctgccggtggccactcccgacccgggcatgttcccgtgcctccaccattcccagaacctgctgcgggccgtgtccaatatgctccagaaggcaaggcagaccctggagttctacccctgcaccagcgaggagatcgatcacgaggacatcaccaaagacaaaaccagcacggtcgaggcctgcctgcccctggaactcaccaagaacgaaagctgtctcaacagccgcgagaccagcttcataaccaacggttcctgtctggcctcccgcaagaccagctttatgatggccctctgtctgagctccatctatgaagacctgaaaatgtaccaggtggagttcaaaaccatgaacgccaagcttctgatggaccccaagaggcagatcttcctggatcagaacatgctggccgtgatcgacgagctgatgcaggccctgaactttaactccgagaccgtgccccagaaaagcagcctggaagagcccgatttctacaaaacgaagatcaagctgtgcatcctgctgcacgccttccggatccgtgcggtgaccatcgatagggtgatgagctacctgaacgccagc

SEQ ID NO: 39 - DNA, 1596 bp, Artificial Sequence
  Synthetic: hIL12AB_035 ORF
atgtgccaccaacagctggtaatcagctggttcagcctggttttcctcgcgtcgcccctggtggccatctgggagttaaagaaggacgtgtacgtggtggagctggattggtaccccgacgccccgggcgagatggtcgtgctcacctgcgatacccccgaggaggacgggatcacctggaccctggaccaatccagcgaggtgctgggcagcggcaagaccctgaccatacaggtgaaggaatttggggacgccgggcagtacacctgccacaagggcggggaagtgctgtcccactccctcctgctgctgcataagaaggaggacggcatctggagcaccgacatcctgaaggaccaaaaggagcccaagaacaagaccttcctgaggtgcgaggccaaaaactattccggccgctttacctgttggtggctgaccaccatctccaccgatctgaccttcagcgtgaagtcgtctaggggctcctccgacccccagggcgtaacctgcggcgccgcgaccctgagcgccgagagggtgcggggcgataacaaagagtacgagtactcggtggagtgccaggaggacagcgcctgtccggcggccgaggagagcctgcccatcgaggtgatggtggacgccgtccacaagctgaagtacgagaactacaccagttcgttcttcatcagggacatcatcaagccggacccccccaagaacctccagctgaagcccctgaagaacagcaggcaggtggaagtgtcctgggagtatcccgacacctggagcaccccccacagctacttcagcctgaccttttgcgtgcaggtgcagggcaaaagcaagagggaaaagaaggaccgggtgttcaccgataagacgagcgccaccgttatctgcaggaagaacgcctccataagcgtgagggcgcaggaccgttactacagcagcagctggagtgagtgggcaagcgtgccctgtagcggcgggggcgggggcgggtcccgcaacctccccgtcgccacccccgacccaggcatgtttccgtgcctgcaccacagccagaacctgctgcgggccgttagcaacatgctgcagaaggccaggcagaccctcgagttctatccctgcacatctgaggagatcgaccacgaagacatcactaaggataagacctccaccgtggaggcctgtctgcccctcgagctgaccaagaatgaatcctgcctgaacagccgagagaccagctttatcaccaacggctcctgcctggccagcaggaagacctccttcatgatggccctgtgcctctccagcatctacgaggatctgaagatgtaccaggtagagttcaagacgatgaacgccaagctcctgatggaccccaagaggcagatattcctggaccagaacatgctggcggtgatcgacgagctgatgcaggccctgaatttcaacagcgagacggtgccacagaagtccagcctggaggagccagacttctacaagaccaagatcaaactgtgcatcctcctgcacgcgttcaggatccgcgccgtcaccatagacagggtgatgagttatctgaacgccagc

SEQ ID NO: 40 - DNA, 1596 bp, Artificial Sequence
  Synthetic: hIL12AB_036 ORF
atgtgccatcagcagctggtaatcagctggtttagcctggtgttcctggccagcccactggtggccatctgggagctgaagaaggacgtgtacgtggtggaactggactggtaccccgacgcccctggcgagatggtggtactgacctgtgacaccccggaggaagacggtatcacctggaccctggatcagagctccgaggtgctgggctccggcaagacactgaccatccaagttaaggaatttggggacgccggccagtacacctgccacaaggggggcgaggtgctgtcccactccctgctgcttctgcataagaaggaggatggcatctggtccaccgacatactgaaggaccagaaggagcccaagaataagaccttcctgagatgcgaggccaagaactactcgggaaggttcacctgctggtggctgaccaccatcagcaccgacctgaccttctccgtgaagagctcccggggcagctccgacccccagggcgtaacctgtggggccgctaccctgtccgccgagagggtccggggcgacaacaaggaatacgagtacagcgtggagtgccaggaggactccgcctgccccgccgccgaggagtcgctgcccatagaggtgatggtggacgccgtgcacaagctcaagtacgagaattacaccagcagcttctttatcagggacataattaagccggaccccccaaagaatctgcagctgaagcccctgaagaatagccggcaggtggaagtgtcctgggagtaccccgacacctggagcaccccccactcctatttctcactgacattctgcgtgcaggtgcaagggaaaagcaagagggagaagaaggatagggtgttcaccgacaagacaagcgccaccgtgatctgccgaaaaaatgccagcatcagcgtgagggcccaggatcggtattacagcagctcctggagcgagtgggccagcgtgccctgttccggcgggggagggggcggctcccggaacctgccggtggccacccccgaccctggcatgttcccctgcctgcatcacagccagaacctgctccgggccgtgtcgaacatgctgcagaaggcccggcagaccctcgagttttacccctgcaccagcgaagagatcgaccacgaagacataaccaaggacaagaccagcacggtggaggcctgcctgcccctggagcttaccaaaaacgagtcctgcctgaacagccgggaaaccagcttcataacgaacgggagctgcctggcctccaggaagaccagcttcatgatggcgctgtgtctgtccagcatatacgaggatctgaagatgtatcaggtggaattcaaaactatgaatgccaagctcctgatggaccccaagaggcagatcttcctggaccagaacatgctagccgtgatcgacgagctgatgcaggccctcaacttcaactcggagacggtgccccagaagtccagcctcgaggagcccgacttctacaagaccaagatcaagctgtgcatactgctgcatgccttcaggataagggcggtgactatcgacagggtcatgtcctacctgaacgccagc

SEQ ID NO: 41 - DNA, 1596 bp, Artificial Sequence
  Synthetic: hIL12AB_037 ORF
atgtgccaccaacaactggtgatcagctggttctccctggtgttcctggccagccccctggtggccatctgggagctcaaaaaagacgtgtacgtggtggagctcgattggtacccagacgcgccgggggaaatggtggtgctgacctgcgacaccccagaggaggatggcatcacgtggacgctggatcagtccagcgaggtgctggggagcggcaagacgctcaccatccaggtgaaggaatttggcgacgcgggccagtatacctgtcacaagggcggcgaggtgctgagccactccctgctgctgctgcacaagaaggaggatgggatctggtcaaccgatatcctgaaagaccagaaggagcccaagaacaagaccttcctgcgctgcgaggccaagaactatagcggcaggttcacctgctggtggctgaccaccatcagcaccgacctgaccttcagcgtgaaatcctccaggggcagcagcgacccccagggcgtgacctgcggtgccgccacgctctccgccgagcgagtgaggggtgacaacaaggagtacgagtacagcgtggaatgtcaggaggacagcgcctgtcccgccgccgaggagtcgctgcccatcgaggtgatggtcgacgcggtgcacaagctcaaatacgagaattacaccagcagcttcttcatcagggacatcatcaagcccgacccccccaagaacctgcagctgaagcccttgaagaacagcaggcaggtggaggtgagctgggagtacccggacacctggagcaccccccactcctacttcagcctgacgttctgtgtgcaggtgcaggggaagtccaagagggagaagaaggaccgggtgttcaccgacaagaccagcgccaccgtgatatgccgcaagaacgcgtccatcagcgttcgcgcccaggaccgctactacagcagctcctggtccgaatgggccagcgtgccctgcagcggtggagggggcgggggctccaggaatctgccggtggccacccccgaccccgggatgttcccgtgtctgcatcactcccagaacctgctgcgggccgtgagcaatatgctgcagaaggccaggcagacgctcgagttctacccctgcacctccgaagagatcgaccatgaggacatcaccaaggacaagaccagcaccgtggaggcctgcctccccctggagctgaccaaaaacgagagctgcctgaactccagggagaccagctttataaccaacggcagctgcctcgcctccaggaagacctcgtttatgatggccctctgcctgtccagcatctacgaggacctgaagatgtaccaggtggagttcaagaccatgaacgcgaagttgctcatggaccccaagaggcagatcttcctggaccagaacatgctcgcggtgatcgacgagctgatgcaagccctgaacttcaacagcgagaccgtgccccagaagagcagcctggaagagcccgacttctacaagaccaagatcaagctgtgcatcctgctgcacgccttccggatccgggccgtgaccatcgacagggtgatgagctacctcaacgcctcc

SEQ ID NO: 42 - DNA, 1596 bp, Artificial Sequence
  Synthetic: hIL12AB_038 ORF
atgtgccaccagcagctcgtgatcagctggttctccctcgtcttcctggcctccccgctggtggccatctgggagctgaagaaggacgtgtacgtggtggagctggactggtatcccgacgcccccggcgagatggtggtgctgacgtgcgacacaccagaagaggacgggatcacatggaccctggatcagtcgtccgaggtgctggggagcggcaagaccctcaccatccaagtgaaggagttcggggacgccggccagtacacctgccacaagggcggggaggtgctctcccatagcctgctcctcctgcacaaaaaggaggatggcatctggagcaccgacatcctgaaggaccagaaggagcccaagaacaagacatttctcaggtgtgaggccaagaactattcgggcaggtttacctgttggtggctcaccaccatctctaccgacctgacgttctccgtcaagtcaagcagggggagctcggacccccagggggtgacatgtggggccgccaccctgagcgcggagcgtgtccgcggcgacaacaaggagtacgagtattccgtggagtgccaggaggacagcgcctgccccgccgccgaggagtccctgcccatagaggtgatggtggacgccgtccacaagttgaagtacgaaaattatacctcctcgttcttcattagggacatcatcaagcctgaccccccgaagaacctacaactcaagcccctcaagaactcccgccaggtggaggtgtcctgggagtaccccgacacctggtccaccccgcacagctacttcagcctgaccttctgcgtgcaggtccaggggaagagcaagcgtgaaaagaaagacagggtgttcaccgacaagacgagcgccaccgtgatctgcaggaaaaacgcctccatctccgtgcgcgcccaggacaggtactacagtagctcctggagcgaatgggccagcgtgccgtgcagcggcgggggaggaggcggcagtcgcaacctgcccgtggccacccccgaccccggcatgttcccatgcctgcaccacagccagaacctgctgagggcagtcagcaatatgctgcagaaggccaggcagaccctggagttttatccctgcaccagcgaggagatcgaccacgaggacatcaccaaggacaagacctccaccgtcgaggcctgcctgccactggagctgaccaaaaacgagagctgcctgaactccagggagacctccttcatcaccaacgggagctgcctggccagccggaagaccagcttcatgatggcgctgtgcctcagcagcatctacgaggatctcaagatgtaccaggtggagttcaagaccatgaacgcgaagctgctgatggaccccaagcggcagatcttcctggaccagaacatgctggccgtgattgacgagctcatgcaggccctgaacttcaatagcgagaccgtcccccaaaagagcagcctggaggaacccgacttctacaaaacgaagatcaagctctgcatcctgctgcacgccttccggatccgggccgtgaccatcgatcgtgtgatgagctacctgaacgcctcg

SEQ ID NO: 43 - DNA, 1596 bp, Artificial Sequence
  Synthetic: hIL12AB_039 ORF
atgtgccaccagcagctcgtcatctcctggtttagcctggtgtttctggcctcccccctggtcgccatctgggagctgaagaaagacgtgtacgtggtggagctggactggtacccggacgctcccggggagatggtggtgctgacctgcgacacccccgaggaggacggcatcacctggaccctggaccagagctccgaggtgctggggagcggcaagaccctgaccattcaggtgaaagagttcggcgacgccggccaatatacctgccacaaggggggggaggtcctgtcgcattccctgctgctgcttcacaaaaaggaggatggcatctggagcaccgacatcctgaaggaccagaaagaacccaagaacaagacgttcctgcgctgcgaggccaagaactacagcggccggttcacctgttggtggctgaccaccatctccaccgacctgactttctcggtgaagagcagccgcgggagcagcgacccccagggagtgacctgcggcgccgccaccctgagcgccgaaagggtgaggggcgacaataaagagtacgagtattccgtggagtgccaggaggacagcgcctgtcccgccgccgaggagtccctgcctatcgaggtgatggtcgacgcggtgcacaagctcaagtacgaaaactacaccagcagctttttcatcagggatatcatcaaaccagacccccccaagaacctgcagctgaagcccctgaaaaacagcaggcaggtggaagtgagctgggaataccccgatacctggtccaccccccacagctacttcagcctgaccttctgcgtgcaggtgcaggggaagtccaagcgggagaagaaagatcgggtgttcacggacaagaccagcgccaccgtgatttgcaggaaaaacgccagcatctccgtgagggctcaggacaggtactacagctccagctggagcgagtgggcctccgtgccttgcagcgggggaggaggcggcggcagcaggaatctgcccgtcgcaacccccgaccccggcatgttcccctgcctgcaccacagccagaatctgctgcgagccgtgagcaacatgctccagaaggcccggcagacgctggagttctacccctgcacctccgaggagatcgaccacgaggacatcaccaaggataagacgagcaccgtcgaggcctgtctccccctggagctcaccaagaacgagtcctgcctgaatagcagggagacgtccttcataaccaacggcagctgtctggcgtccaggaagaccagcttcatgatggccctctgcctgagctccatctacgaggacctcaagatgtaccaggtcgagttcaagaccatgaacgcaaaactgctcatggatccaaagaggcagatctttctggaccagaacatgctggccgtgatcgatgaactcatgcaggccctgaatttcaattccgagaccgtgccccagaagagctccctggaggaacccgacttctacaaaacaaagatcaagctgtgtatcctcctgcacgccttccggatcagggccgtcaccattgaccgggtgatgtcctacctgaacgccagc

SEQ ID NO: 44 - DNA, 1596 bp, Artificial Sequence
  Synthetic: hIL12AB_040 ORF
atgtgccatcagcagctggtgatcagctggttcagcctcgtgttcctcgccagccccctcgtggccatctgggagctgaaaaaggacgtgtacgtggtggagctggactggtatcccgacgccccgggcgagatggtggtgctgacctgcgacacccccgaggaggacggcattacctggacactggaccagagcagcgaggtcctgggcagcgggaagaccctgacaattcaggtgaaggagttcggcgacgccggacagtacacgtgccacaaggggggggaggtgctgtcccacagcctcctcctgctgcacaagaaggaggatggcatctggagcaccgacatcctgaaggatcagaaggagcccaagaacaagacctttctgagatgcgaggccaagaattacagcggccgtttcacctgctggtggctcaccaccatcagcaccgacctgaccttcagcgtgaaatcctccaggggctcctccgacccgcagggagtgacctgcggcgccgccacactgagcgccgagcgggtcagaggggacaacaaggagtacgagtacagcgttgagtgccaggaggacagcgcctgtcccgcggccgaggaatccctgcccatcgaggtgatggtggacgcagtgcacaagctgaagtacgagaactatacctcgagcttcttcatccgggatatcattaagcccgatcccccgaagaacctgcagctcaaacccctgaagaacagcaggcaggtggaggtctcctgggagtaccccgacacatggtccaccccccattcctatttctccctgaccttttgcgtgcaggtgcagggcaagagcaagagggagaaaaaggacagggtgttcaccgacaagacctccgccaccgtgatctgccgtaagaacgctagcatcagcgtcagggcccaggacaggtactatagcagctcctggtccgagtgggccagcgtcccgtgcagcggcgggggcggtggaggctcccggaacctccccgtggccaccccggaccccgggatgtttccctgcctgcatcacagccagaacctgctgagggccgtgtccaacatgctgcagaaggccaggcagacactcgagttttacccctgcaccagcgaggagatcgaccacgaagacatcaccaaggacaagacctccaccgtggaggcatgcctgcccctggagctgaccaaaaacgaaagctgtctgaactccagggagacctcctttatcacgaacggctcatgcctggcctccagaaagaccagcttcatgatggccctgtgcctgagctccatctacgaggacttgaaaatgtaccaggtcgagttcaagaccatgaacgccaagctgctcatggaccccaaaaggcagatctttctggaccagaatatgctggccgtgatcgacgagctcatgcaagccctgaatttcaacagcgagaccgtgccccagaagtcctccctggaggagcccgacttctacaagaccaagatcaagctgtgcatactcctgcacgcgtttaggatcagggcggtgaccatcgatagggtgatgagctacctgaatgcctcc

SEQ ID NO: 45 - protein, 22 aa, Artificial Sequence
  Synthetic: Wild Type IL12B signal peptide Amino acids
MCHQQLVISWFSLVFLASPLVA

SEQ ID NO: 46 - DNA, 66 bp, Artificial Sequence
  Synthetic: Wild Type IL12B signal peptide Nucleic acids
atgtgtcaccagcagttggtcatctcttggttttccctggtttttctggcatctcccctcgtggcc

SEQ ID NO: 47 - DNA, 18 bp, Artificial Sequence
  Synthetic: Syn 5 promoter
attgggcacccgtaaggg

SEQ ID NO: 48 - protein, 532 aa, Artificial Sequence
  Synthetic: Signal peptide-IL12B-linker-IL12A amino acid sequence #1
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 49 - protein, 533 aa, Artificial Sequence
  Synthetic: Signal peptide-IL12B-linker-IL12A amino acid sequence #2
MGCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 50 - RNA, 85 nt, Artificial Sequence
  Synthetic: miR-122
ccuuagcagagcuguggagugugacaaugguguuugugucuaaacuaucaaacgccauuaucacacuaaauagcuacugcuaggc

SEQ ID NO: 51 - RNA, 22 nt, Artificial Sequence
  Synthetic: miR-122-3p
aacgccauuaucacacuaaaua

SEQ ID NO: 52 - RNA, 22 nt, Artificial Sequence
  Synthetic: miR-122-3p binding site
uauuuagugugauaauggcguu

SEQ ID NO: 53 - RNA, 22 nt, Artificial Sequence
  Synthetic: miR-122-5p
uggagugugacaaugguguuug

SEQ ID NO: 54 - RNA, 22 nt, Artificial Sequence
  Synthetic: miR-122-5p binding site
caaacaccauugucacacucca

SEQ ID NO: 55 - RNA, 47 nt, Artificial Sequence
  Synthetic: 5'UTR-017
gggaaauaagagagaaaagaagaguaagaagaaauuuaagagccacc

SEQ ID NO: 56 - RNA, 92 nt, Artificial Sequence
  Synthetic: 5'UTR-018
ucaagcuuuuggacccucguacagaagcuaauacgacucacuauagggaaauaagagagaaaagaagaguaagaagaaauauaagagccacc

SEQ ID NO: 57 - RNA, 142 nt, Artificial Sequence
  Synthetic: 142-3p 5'UTR-001
ugauaauaguccauaaaguaggaaacacuacagcuggagccucgguggccaugcuucuugccccuugggccuccccccagccccuccuccccuuccugcacccguacccccguggucuuugaauaaagucugagugggcggc

SEQ ID NO: 58 - RNA, 142 nt, Artificial Sequence
  Synthetic: 142-3p 5'UTR-002
ugauaauaggcuggagccucgguggcuccauaaaguaggaaacacuacacaugcuucuugccccuugggccuccccccagccccuccuccccuuccugcacccguacccccguggucuuugaauaaagucugagugggcggc

SEQ ID NO: 59 - RNA, 142 nt, Artificial Sequence
  Synthetic: 142-3p  5'UTR-003
ugauaauaggcuggagccucgguggccaugcuucuugccccuuccauaaaguaggaaacacuacaugggccuccccccagccccuccuccccuuccugcacccguacccccguggucuuugaauaaagucugagugggcggc

SEQ ID NO: 60 - RNA, 142 nt, Artificial Sequence
  Synthetic: 142-3p  5'UTR-004
ugauaauaggcuggagccucgguggccaugcuucuugccccuugggccuccccccaguccauaaaguaggaaacacuacaccccuccuccccuuccugcacccguacccccguggucuuugaauaaagucugagugggcggc

SEQ ID NO: 61 - RNA, 142 nt, Artificial Sequence
  Synthetic: 142-3p  5'UTR-005
ugauaauaggcuggagccucgguggccaugcuucuugccccuugggccuccccccagccccuccuccccuucuccauaaaguaggaaacacuacacugcacccguacccccguggucuuugaauaaagucugagugggcggc

SEQ ID NO: 62 - RNA, 142 nt, Artificial Sequence
  Synthetic: 142-3p  5'UTR-006
ugauaauaggcuggagccucgguggccaugcuucuugccccuugggccuccccccagccccuccuccccuuccugcacccguacccccuccauaaaguaggaaacacuacaguggucuuugaauaaagucugagugggcggc

SEQ ID NO: 63 - RNA, 142 nt, Artificial Sequence
  Synthetic: 142-3p  5'UTR-007
ugauaauaggcuggagccucgguggccaugcuucuugccccuugggccuccccccagccccuccuccccuuccugcacccguacccccguggucuuugaauaaaguuccauaaaguaggaaacacuacacugagugggcggc

SEQ ID NO: 64 - RNA, 371 nt, Artificial Sequence
  Synthetic: 3'UTR-001  (Creatine  Kinase  UTR)
gcgccugcccaccugccaccgacugcuggaacccagccagugggagggccuggcccaccagaguccugcucccucacuccucgccccgcccccugucccagagucccaccugggggcucucuccacccuucucagaguuccaguuucaaccagaguuccaaccaaugggcuccauccucuggauucuggccaaugaaauaucucccuggcaggguccucuucuuuucccagagcuccaccccaaccaggagcucuaguuaauggagagcucccagcacacucggagcuugugcuuugucuccacgcaaagcgauaaauaaaagcauugguggccuuuggucuuugaauaaagccugaguaggaagucuaga

SEQ ID NO: 65 - RNA, 568 nt, Artificial Sequence
  Synthetic: 3'UTR-002 (Myoglobin UTR)
gccccugccgcucccacccccacccaucugggccccggguucaagagagagcggggucugaucucguguagccauauagaguuugcuucugagugucugcuuuguuuaguagaggugggcaggaggagcugaggggcuggggcugggguguugaaguuggcuuugcaugcccagcgaugcgccucccugugggaugucaucacccugggaaccgggaguggcccuuggcucacuguguucugcaugguuuggaucugaauuaauuguccuuucuucuaaaucccaaccgaacuucuuccaaccuccaaacuggcuguaaccccaaauccaagccauuaacuacaccugacaguagcaauugucugauuaaucacuggccccuugaagacagcagaaugucccuuugcaaugaggaggagaucugggcugggcgggccagcuggggaagcauuugacuaucuggaacuugugugugccuccucagguauggcagugacucaccugguuuuaauaaaacaaccugcaacaucucauggucuuugaauaaagccugaguaggaagucuaga

SEQ ID NO: 66 - RNA, 289 nt, Artificial Sequence
  Synthetic: 3'UTR-003 (?-actin UTR)
acacacuccaccuccagcacgcgacuucucaggacgacgaaucuucucaaugggggggcggcugagcuccagccaccccgcagucacuuucuuuguaacaacuuccguugcugccaucguaaacugacacaguguuuauaacguguacauacauuaacuuauuaccucauuuuguuauuuuucgaaacaaagcccuguggaagaaaauggaaaacuugaagaagcauuaaagucauucuguuaagcugcguaaauggucuuugaauaaagccugaguaggaagucuaga

SEQ ID NO: 67 - RNA, 379 nt, Artificial Sequence
  Synthetic: 3'UTR-004 (Albumin UTR)
caucacauuuaaaagcaucucagccuaccaugagaauaagagaaagaaaaugaagaucaaaagcuuauucaucuguuuuucuuuuucguugguguaaagccaacacccugucuaaaaaacauaaauuucuuuaaucauuuugccucuuuucucugugcuucaauuaauaaaaaauggaaagaaucuaauagagugguacagcacuguuauuuuucaaagauguguugcuauccugaaaauucuguagguucuguggaaguuccaguguucucucuuauuccacuucgguagaggauuucuaguuucuugugggcuaauuaaauaaaucauuaauacucuucuaauggucuuugaauaaagccugaguaggaagucuaga

SEQ ID NO: 68 - RNA, 118 nt, Artificial Sequence
  Synthetic: 3'UTR-005 (?-globin UTR)
gcugccuucugcggggcuugccuucuggccaugcccuucuucucucccuugcaccuguaccucuuggucuuugaauaaagccugaguaggaaggcggccgcucgagcaugcaucuaga

SEQ ID NO: 69 - RNA, 908 nt, Artificial Sequence
  Synthetic: 3'UTR-006 (G-CSF UTR)
gccaagcccuccccaucccauguauuuaucucuauuuaauauuuaugucuauuuaagccucauauuuaaagacagggaagagcagaacggagccccaggccucuguguccuucccugcauuucugaguuucauucuccugccuguagcagugagaaaaagcuccuguccucccauccccuggacugggagguagauagguaaauaccaaguauuuauuacuaugacugcuccccagcccuggcucugcaaugggcacugggaugagccgcugugagccccugguccugaggguccccaccugggacccuugagaguaucaggucucccacgugggagacaagaaaucccuguuuaauauuuaaacagcaguguuccccaucuggguccuugcaccccucacucuggccucagccgacugcacagcggccccugcauccccuuggcugugaggccccuggacaagcagagguggccagagcugggaggcauggcccuggggucccacgaauuugcuggggaaucucguuuuucuucuuaagacuuuugggacaugguuugacucccgaacaucaccgacgcgucuccuguuuuucuggguggccucgggacaccugcccugcccccacgagggucaggacugugacucuuuuuagggccaggcaggugccuggacauuugccuugcuggacggggacuggggaugugggagggagcagacaggaggaaucaugucaggccugugugugaaaggaagcuccacugucacccuccaccucuucaccccccacucaccaguguccccuccacugucacauuguaacugaacuucaggauaauaaaguguuugccuccauggucuuugaauaaagccugaguaggaaggcggccgcucgagcaugcaucuaga

SEQ ID NO: 70 - RNA, 835 nt, Artificial Sequence
  Synthetic: 3'UTR-007 (Col1a2; collagen, Type I, alpha 2 UTR)
acucaaucuaaauuaaaaaagaaagaaauuugaaaaaacuuucucuuugccauuucuucuucuucuuuuuuaacugaaagcugaauccuuccauuucuucugcacaucuacuugcuuaaauugugggcaaaagagaaaaagaaggauugaucagagcauugugcaauacaguuucauuaacuccuucccccgcucccccaaaaauuugaauuuuuuuuucaacacucuuacaccuguuauggaaaaugucaaccuuuguaagaaaaccaaaauaaaaauugaaaaauaaaaaccauaaacauuugcaccacuuguggcuuuugaauaucuuccacagagggaaguuuaaaacccaaacuuccaaagguuuaaacuaccucaaaacacuuucccaugagugugauccacauuguuaggugcugaccuagacagagaugaacugagguccuuguuuuguuuuguucauaauacaaaggugcuaauuaauaguauuucagauacuugaagaauguugauggugcuagaagaauuugagaagaaauacuccuguauugaguuguaucgugugguguauuuuuuaaaaaauuugauuuagcauucauauuuuccaucuuauucccaauuaaaaguaugcagauuauuugcccaaaucuucuucagauucagcauuuguucuuugccagucucauuuucaucuucuuccaugguuccacagaagcuuuguuucuugggcaagcagaaaaauuaaauuguaccuauuuuguauaugugagauguuuaaauaaauugugaaaaaaaugaaauaaagcauguuugguuuuccaaaagaacauau

SEQ ID NO: 71 - RNA, 297 nt, Artificial Sequence
  Synthetic: 3'UTR-008 (Col6a2; collagen, Type VI, alpha 2 UTR)
cgccgccgcccgggccccgcagucgagggucgugagcccaccccguccauggugcuaagcgggcccgggucccacacggccagcaccgcugcucacucggacgacgcccugggccugcaccucuccagcuccucccacgggguccccguagccccggcccccgcccagccccaggucuccccaggcccuccgcaggcugcccggccucccucccccugcagccaucccaaggcuccugaccuaccuggccccugagcucuggagcaagcccugacccaauaaaggcuuugaacccau

SEQ ID NO: 72 - RNA, 602 nt, Artificial Sequence
  Synthetic: 3'UTR-009 (RPN1; ribophorin I UTR)
ggggcuagagcccucuccgcacagcguggagacggggcaaggagggggguuauuaggauuggugguuuuguuuugcuuuguuuaaagccgugggaaaauggcacaacuuuaccucugugggagaugcaacacugagagccaaggggugggaguugggauaauuuuuauauaaaagaaguuuuuccacuuugaauugcuaaaaguggcauuuuuccuaugugcagucacuccucucauuucuaaaauagggacguggccaggcacgguggcucaugccuguaaucccagcacuuugggaggccgaggcaggcggcucacgaggucaggagaucgagacuauccuggcuaacacgguaaaacccugucucuacuaaaaguacaaaaaauuagcugggcgugguggugggcaccuguagucccagcuacucgggaggcugaggcaggagaaaggcaugaauccaagaggcagagcuugcagugagcugagaucacgccauugcacuccagccugggcaacaguguuaagacucugucucaaauauaaauaaauaaauaaauaaauaaauaaauaaauaaaaauaaagcgagauguugcccucaaa

SEQ ID NO: 73 - RNA, 785 nt, Artificial Sequence
  Synthetic: 3'UTR-010 (LRP1; low density lipoprotein receptor-related protein 1 UTR)
ggcccugccccgucggacugcccccagaaagccuccugcccccugccagugaaguccuucagugagccccuccccagccagcccuucccuggccccgccggauguauaaauguaaaaaugaaggaauuacauuuuauaugugagcgagcaagccggcaagcgagcacaguauuauuucuccauccccucccugccugcuccuuggcacccccaugcugccuucagggagacaggcagggagggcuuggggcugcaccuccuacccucccaccagaacgcaccccacugggagagcugguggugcagccuuccccucccuguauaagacacuuugccaaggcucuccccucucgccccaucccugcuugcccgcucccacagcuuccugagggcuaauucugggaagggagaguucuuugcugccccugucuggaagacguggcucugggugagguaggcgggaaaggauggaguguuuuaguucuugggggaggccaccccaaaccccagccccaacuccaggggcaccuaugagauggccaugcucaaccccccucccagacaggcccucccugucuccagggcccccaccgagguucccagggcuggagacuuccucugguaaacauuccuccagccuccccuccccuggggacgccaaggaggugggccacacccaggaagggaaagcgggcagccccguuuuggggacgugaacguuuuaauaauuuuugcugaauuccuuuacaacuaaauaacacagauauuguuauaaauaaaauugu

SEQ ID NO: 74 - RNA, 3001 nt, Artificial Sequence
  Synthetic: 3'UTR-011 (Nnt1; cardiotrophin-like cytokine factor 1 UTR)
auauuaaggaucaagcuguuagcuaauaaugccaccucugcaguuuugggaacaggcaaauaaaguaucaguauacauggugauguacaucuguagcaaagcucuuggagaaaaugaagacugaagaaagcaaagcaaaaacuguauagagagauuuuucaaaagcaguaaucccucaauuuuaaaaaaggauugaaaauucuaaaugucuuucugugcauauuuuuuguguuaggaaucaaaaguauuuuauaaaaggagaaagaacagccucauuuuagauguaguccuguuggauuuuuuaugccuccucaguaaccagaaauguuuuaaaaaacuaaguguuuaggauuucaagacaacauuauacauggcucugaaauaucugacacaauguaaacauugcaggcaccugcauuuuauguuuuuuuuuucaacaaaugugacuaauuugaaacuuuuaugaacuucugagcuguccccuugcaauucaaccgcaguuugaauuaaucauaucaaaucaguuuuaauuuuuuaaauuguacuucagagucuauauuucaagggcacauuuucucacuacuauuuuaauacauuaaaggacuaaauaaucuuucagagaugcuggaaacaaaucauuugcuuuauauguuucauuagaauaccaaugaaacauacaacuugaaaauuaguaauaguauuuuugaagaucccauuucuaauuggagaucucuuuaauuucgaucaacuuauaauguguaguacuauauuaagugcacuugaguggaauucaacauuugacuaauaaaaugaguucaucauguuggcaagugauguggcaauuaucucuggugacaaaagaguaaaaucaaauauuucugccuguuacaaauaucaaggaagaccugcuacuaugaaauagaugacauuaaucugucuucacuguuuauaauacggauggauuuuuuuucaaaucaguguguguuuugaggucuuauguaauugaugacauuugagagaaaugguggcuuuuuuuagcuaccucuuuguucauuuaagcaccaguaaagaucaugucuuuuuauagaaguguagauuuucuuugugacuuugcuaucgugccuaaagcucuaaauauaggugaaugugugaugaauacucagauuauuugucucucuauauaauuaguuugguacuaaguuucucaaaaaauuauuaacacaugaaagacaaucucuaaaccagaaaaagaaguaguacaaauuuuguuacuguaaugcucgcguuuagugaguuuaaaacacacaguaucuuuugguuuuauaaucaguuucuauuuugcugugccugagauuaagaucuguguaugugugugugugugugugugcguuuguguguuaaagcagaaaagacuuuuuuaaaaguuuuaagugauaaaugcaauuuguuaauugaucuuagaucacuaguaaacucagggcugaauuauaccauguauauucuauuagaagaaaguaaacaccaucuuuauuccugcccuuuuucuucucucaaaguaguuguaguuauaucuagaaagaagcaauuuugauuucuugaaaagguaguuccugcacucaguuuaaacuaaaaauaaucauacuuggauuuuauuuauuuuugucauaguaaaaauuuuaauuuauauauauuuuuauuuaguauuaucuuauucuuugcuauuugccaauccuuugucaucaauuguguuaaaugaauugaaaauucaugcccuguucauuuuauuuuacuuuauugguuaggauauuuaaaggauuuuuguauauauaauuucuuaaauuaauauuccaaaagguuaguggacuuagauuauaaauuauggcaaaaaucuaaaaacaacaaaaaugauuuuuauacauucuauuucauuauuccucuuuuuccaauaagucauacaauugguagauaugacuuauuuuauuuuuguauuauucacuauaucuuuaugauauuuaaguauaaauaauuaaaaaaauuuauuguaccuuauagucugucaccaaaaaaaaaaaauuaucuguagguagugaaaugcuaauguugauuugucuuuaagggcuuguuaacuauccuuuauuuucucauuugucuuaaauuaggaguuuguguuuaaauuacucaucuaagcaaaaaauguauauaaaucccauuacuggguauauacccaaaggauuauaaaucaugcugcuauaaagacacaugcacacguauguuuauugcagcacuauucacaauagcaaagacuuggaaccaacccaaauguccaucaaugauagacuugauuaagaaaaugugcacauauacaccauggaauacuaugcagccauaaaaaaggaugaguucauguccuuuguagggacauggauaaagcuggaaaccaucauucugagcaaacuauugcaaggacagaaaaccaaacacugcauguucucacucauaggugggaauugaacaaugagaacacuuggacacaagguggggaacaccacacaccagggccugucaugggguggggggaguggggagggauagcauuaggagauauaccuaauguaaaugaugaguuaaugggugcagcacaccaacauggcacauguauacauauguagcaaaccugcacguugugcacauguacccuagaacuuaaaguauaauuaaaaaaaaaaagaaaacagaagcuauuuauaaagaaguuauuugcugaaauaaaugugaucuuucccauuaaaaaaauaaagaaauuuugggguaaaaaaacacaauauauuguauucuugaaaaauucuaagagaguggaugugaaguguucucaccacaaaagugauaacuaauugagguaaugcacauauuaauuagaaagauuuugucauuccacaauguauauauacuuaaaaauauguuauacacaauaaauacauacauuaaaaaauaaguaaaugua

SEQ ID NO: 75 - RNA, 1037 nt, Artificial Sequence
  Synthetic: 3'UTR-012 (Col6a1; collagen, Type VI, alpha 1 UTR)
cccacccugcacgccggcaccaaacccuguccucccaccccuccccacucaucacuaaacagaguaaaaugugaugcgaauuuucccgaccaaccugauucgcuagauuuuuuuuaaggaaaagcuuggaaagccaggacacaacgcugcugccugcuuugugcaggguccuccggggcucagcccugaguuggcaucaccugcgcagggcccucuggggcucagcccugagcuagugucaccugcacagggcccucugaggcucagcccugagcuggcgucaccugugcagggcccucuggggcucagcccugagcuggccucaccuggguuccccaccccgggcucuccugcccugcccuccugcccgcccucccuccugccugcgcagcuccuucccuaggcaccucugugcugcaucccaccagccugagcaagacgcccucucggggccugugccgcacuagccucccucuccucuguccccauagcugguuuuucccaccaauccucaccuaacaguuacuuuacaauuaaacucaaagcaagcucuucuccucagcuuggggcagccauuggccucugucucguuuugggaaaccaaggucaggaggccguugcagacauaaaucucggcgacucggccccgucuccugaggguccugcuggugaccggccuggaccuuggcccuacagcccuggaggccgcugcugaccagcacugaccccgaccucagagaguacucgcaggggcgcuggcugcacucaagacccucgagauuaacggugcuaaccccgucugcuccucccucccgcagagacuggggccuggacuggacaugagagccccuuggugccacagagggcugugucuuacuagaaacaacgcaaaccucuccuuccucagaauagugauguguucgacguuuuaucaaaggcccccuuucuauguucauguuaguuuugcuccuucuguguuuuuuucugaaccauauccauguugcugacuuuuccaaauaaagguuuucacuccucuc

SEQ ID NO: 76 - RNA, 577 nt, Artificial Sequence
  Synthetic: 3'UTR-013 (Calr; calreticulin UTR)
agaggccugccuccagggcuggacugaggccugagcgcuccugccgcagagcuggccgcgccaaauaaugucucugugagacucgagaacuuucauuuuuuuccaggcugguucggauuugggguggauuuugguuuuguuccccuccuccacucucccccacccccuccccgcccuuuuuuuuuuuuuuuuuuaaacugguauuuuaucuuugauucuccuucagcccucaccccugguucucaucuuucuugaucaacaucuuuucuugccucuguccccuucucucaucucuuagcuccccuccaaccuggggggcagugguguggagaagccacaggccugagauuucaucugcucuccuuccuggagcccagaggagggcagcagaaggggguggugucuccaaccccccagcacugaggaagaacggggcucuucucauuucaccccucccuuucuccccugcccccaggacugggccacuucuggguggggcagugggucccagauuggcucacacugagaauguaagaacuacaaacaaaauuucuauuaaauuaaauuuugugucucc

SEQ ID NO: 77 - RNA, 2212 nt, Artificial Sequence
  Synthetic: 3'UTR-014 (Col1a1; collagen, Type I, alpha 1 UTR)
cucccuccaucccaaccuggcucccucccacccaaccaacuuuccccccaacccggaaacagacaagcaacccaaacugaacccccucaaaagccaaaaaaugggagacaauuucacauggacuuuggaaaauauuuuuuuccuuugcauucaucucucaaacuuaguuuuuaucuuugaccaaccgaacaugaccaaaaaccaaaagugcauucaaccuuaccaaaaaaaaaaaaaaaaaaagaauaaauaaauaacuuuuuaaaaaaggaagcuugguccacuugcuugaagacccaugcggggguaagucccuuucugcccguugggcuuaugaaaccccaaugcugcccuuucugcuccuuucuccacaccccccuuggggccuccccuccacuccuucccaaaucugucuccccagaagacacaggaaacaauguauugucugcccagcaaucaaaggcaaugcucaaacacccaaguggcccccacccucagcccgcuccugcccgcccagcacccccaggcccugggggaccugggguucucagacugccaaagaagccuugccaucuggcgcucccauggcucuugcaacaucuccccuucguuuuugagggggucaugccgggggagccaccagccccucacuggguucggaggagagucaggaagggccacgacaaagcagaaacaucggauuuggggaacgcgugucaaucccuugugccgcagggcugggcgggagagacuguucuguuccuuguguaacuguguugcugaaagacuaccucguucuugucuugaugugucaccggggcaacugccugggggcggggaugggggcaggguggaagcggcuccccauuuuauaccaaaggugcuacaucuaugugaugggugggguggggagggaaucacuggugcuauagaaauugagaugcccccccaggccagcaaauguuccuuuuuguucaaagucuauuuuuauuccuugauauuuuucuuuuuuuuuuuuuuuuuuuguggauggggacuugugaauuuuucuaaaggugcuauuuaacaugggaggagagcgugugcggcuccagcccagcccgcugcucacuuuccacccucucuccaccugccucuggcuucucaggccucugcucuccgaccucucuccucugaaacccuccuccacagcugcagcccauccucccggcucccuccuagucuguccugcguccucuguccccggguuucagagacaacuucccaaagcacaaagcaguuuuucccccuaggggugggaggaagcaaaagacucuguaccuauuuuguauguguauaauaauuugagauguuuuuaauuauuuugauugcuggaauaaagcauguggaaaugacccaaacauaauccgcaguggccuccuaauuuccuucuuuggaguugggggagggguagacauggggaaggggcuuuggggugaugggcuugccuuccauuccugcccuuucccuccccacuauucucuucuagaucccuccauaaccccacuccccuuucucucacccuucuuauaccgcaaaccuuucuacuuccucuuucauuuucuauucuugcaauuuccuugcaccuuuuccaaauccucuucuccccugcaauaccauacaggcaauccacgugcacaacacacacacacacucuucacaucugggguuguccaaaccucauacccacuccccuucaagcccauccacucuccacccccuggaugcccugcacuugguggcggugggaugcucauggauacugggagggugaggggaguggaacccgugaggaggaccugggggccucuccuugaacugacaugaagggucaucuggccucugcucccuucucacccacgcugaccuccugccgaaggagcaacgcaacaggagaggggucugcugagccuggcgagggucugggagggaccaggaggaaggcgugcucccugcucgcuguccuggcccugggggagugagggagacagacaccugggagagcuguggggaaggcacucgcaccgugcucuugggaaggaaggagaccuggcccugcucaccacggacugggugccucgaccuccugaauccccagaacacaaccccccugggcugggguggucuggggaaccaucgugcccccgccucccgccuacuccuuuuuaagcuu

SEQ ID NO: 78 - RNA, 729 nt, Artificial Sequence
  Synthetic: 3'UTR-015 (Plod1; procollagen-lysine, 2-oxoglutarate 5-dioxygenase 1 UTR)
uuggccaggccugacccucuuggaccuuucuucuuugccgacaaccacugcccagcagccucugggaccucggggucccagggaacccaguccagccuccuggcuguugacuucccauugcucuuggagccaccaaucaaagagauucaaagagauuccugcaggccagaggcggaacacaccuuuauggcuggggcucuccgugguguucuggacccagccccuggagacaccauucacuuuuacugcuuuguagugacucgugcucuccaaccugucuuccugaaaaaccaaggcccccuucccccaccucuuccauggggugagacuugagcagaacaggggcuuccccaaguugcccagaaagacugucugggugagaagccauggccagagcuucucccaggcacagguguugcaccagggacuucugcuucaaguuuugggguaaagacaccuggaucagacuccaagggcugcccugagucugggacuucugccuccauggcuggucaugagagcaaaccguaguccccuggagacagcgacuccagagaaccucuugggagacagaagaggcaucugugcacagcucgaucuucuacuugccuguggggaggggagugacagguccacacaccacacugggucacccuguccuggaugccucugaagagagggacagaccgucagaaacuggagaguuucuauuaaaggucauuuaaacca

SEQ ID NO: 79 - RNA, 847 nt, Artificial Sequence
  Synthetic: 3'UTR-016 (Nucb1; nucleobindin 1 UTR)
uccuccgggaccccagcccucaggauuccugaugcuccaaggcgacugaugggcgcuggaugaaguggcacagucagcuucccugggggcuggugucauguugggcuccuggggcgggggcacggccuggcauuucacgcauugcugccaccccagguccaccugucuccacuuucacagccuccaagucuguggcucuucccuucuguccuccgaggggcuugccuucucucguguccagugaggugcucagugaucggcuuaacuuagagaagcccgcccccuccccuucuccgucugucccaagagggucugcucugagccugcguuccuagguggcucggccucagcugccuggguuguggccgcccuagcauccuguaugcccacagcuacuggaauccccgcugcugcuccgggccaagcuucugguugauuaaugagggcaugggguggucccucaagaccuuccccuaccuuuuguggaaccagugaugccucaaagacaguguccccuccacagcugggugccaggggcaggggauccucaguauagccggugaacccugauaccaggagccugggccucccugaaccccuggcuuccagccaucucaucgccagccuccuccuggaccucuuggcccccagccccuuccccacacagccccagaagggucccagagcugaccccacuccaggaccuaggcccagccccucagccucaucuggagccccugaagaccagucccacccaccuuucuggccucaucugacacugcuccgcauccugcuguguguccuguuccauguuccgguuccauccaaauacacuuucuggaacaaa

SEQ ID NO: 80 - RNA, 110 nt, Artificial Sequence
  Synthetic: 3'UTR-017 (?-globin)
gcuggagccucgguggccaugcuucuugccccuugggccuccccccagccccuccuccccuuccugcacccguacccccguggucuuugaauaaagucugagugggcggc

SEQ ID NO: 81 - RNA, 119 nt, Artificial Sequence
  Synthetic: 3'UTR-018
ugauaauaggcuggagccucgguggccaugcuucuugccccuugggccuccccccagccccuccuccccuuccugcacccguacccccguggucuuugaauaaagucugagugggcggc

SEQ ID NO: 82 - RNA, 47 nt, Artificial Sequence
  Synthetic: 5'UTR-001
gggaaauaagagagaaaagaagaguaagaagaaauauaagagccacc

SEQ ID NO: 83 - RNA, 47 nt, Artificial Sequence
  Synthetic: 5'UTR-002
gggagaucagagagaaaagaagaguaagaagaaauauaagagccacc

SEQ ID NO: 84 - RNA, 145 nt, Artificial Sequence
  Synthetic: 5'UTR-003
ggaauaaaagucucaacacaacauauacaaaacaaacgaaucucaagcaaucaagcauucuacuucuauugcagcaauuuaaaucauuucuuuuaaagcaaaagcaauuuucugaaaauuuucaccauuuacgaacgauagcaac

SEQ ID NO: 85 - RNA, 41 nt, Artificial Sequence
  Synthetic: 5'UTR-004
ggagacaagcuuggcauuccgguacuguugguaaagccacc

SEQ ID NO: 86 - RNA, 47 nt, Artificial Sequence; identical to SEQ ID NO: 83
  Synthetic: 5'UTR-005

SEQ ID NO: 87 - RNA, 145 nt, Artificial Sequence; identical to SEQ ID NO: 84
  Synthetic: 5'UTR-006

SEQ ID NO: 88 - RNA, 42 nt, Artificial Sequence
  Synthetic: 5'UTR-007
gggagacaagcuuggcauuccgguacuguugguaaagccacc

SEQ ID NO: 89 - RNA, 47 nt, Artificial Sequence
  Synthetic: 5'UTR-008
gggaauuaacagagaaaagaagaguaagaagaaauauaagagccacc

SEQ ID NO: 90 - RNA, 47 nt, Artificial Sequence
  Synthetic: 5'UTR-009
gggaaauuagacagaaaagaagaguaagaagaaauauaagagccacc

SEQ ID NO: 91 - RNA, 47 nt, Artificial Sequence
  Synthetic: 5'UTR-010
gggaaauaagagaguaaagaacaguaagaagaaauauaagagccacc

SEQ ID NO: 92 - RNA, 47 nt, Artificial Sequence
  Synthetic: 5'UTR-011
gggaaaaaagagagaaaagaagacuaagaagaaauauaagagccacc

SEQ ID NO: 93 - RNA, 47 nt, Artificial Sequence
  Synthetic: 5'UTR-012
gggaaauaagagagaaaagaagaguaagaagauauauaagagccacc

SEQ ID NO: 94 - RNA, 47 nt, Artificial Sequence
  Synthetic: 5'UTR-013
gggaaauaagagacaaaacaagaguaagaagaaauauaagagccacc

SEQ ID NO: 95 - RNA, 47 nt, Artificial Sequence
  Synthetic: 5'UTR-014
gggaaauuagagaguaaagaacaguaaguagaauuaaaagagccacc

SEQ ID NO: 96 - RNA, 47 nt, Artificial Sequence
  Synthetic: 5'UTR-015
gggaaauaagagagaauagaagaguaagaagaaauauaagagccacc

SEQ ID NO: 97 - RNA, 47 nt, Artificial Sequence
  Synthetic: 5'UTR-016
gggaaauaagagagaaaagaagaguaagaagaaaauuaagagccacc

SEQ ID NO: 98 - DNA, 1829 bp, Artificial Sequence
  Synthetic: hIL12AB_001 (5UTR ORF  3UTR)
tcaagcttttggaccctcgtacagaagctaatacgactcactatagggaaataagagagaaaagaagagtaagaagaaatataagagccaccatgtgtcaccagcagctggtcattagctggtttagccttgtgttcctggcctccccccttgtcgctatttgggagctcaagaaggacgtgtacgtggtggagttggattggtacccagacgcgcccggagagatggtagttctgacctgtgataccccagaggaggacggcatcacctggacgctggaccaaagcagcgaggttttgggctcagggaaaacgctgaccatccaggtgaaggaattcggcgacgccgggcagtacacctgccataagggaggagaggtgctgagccattcccttcttctgctgcacaagaaagaggacggcatctggtctaccgacatcctgaaagaccagaaggagcccaagaacaaaaccttcctgaggtgcgaggccaagaactactccggcaggttcacttgttggtggctgaccaccatcagtacagacctgacttttagtgtaaaaagctccagaggctcgtccgatccccaaggggtgacctgcggcgcagccactctgagcgctgagcgcgtgcgcggtgacaataaagagtacgagtacagcgttgagtgtcaagaagatagcgcttgccctgccgccgaggagagcctgcctatcgaggtgatggttgacgcagtgcacaagcttaagtacgagaattacaccagctcattcttcattagagatataatcaagcctgacccacccaagaacctgcagctgaagccactgaaaaactcacggcaggtcgaagtgagctgggagtaccccgacacctggagcactcctcattcctatttctctcttacattctgcgtccaggtgcagggcaagagcaagcgggaaaagaaggatcgagtcttcaccgacaaaacaagcgcgaccgtgatttgcaggaagaacgccagcatctccgtcagagcccaggatagatactatagtagcagctggagcgagtgggcaagcgtgccctgttccggcggcgggggcgggggcagccgaaacttgcctgtcgctaccccggaccctggaatgtttccgtgtctgcaccacagccagaacctgctgagagccgtgtcgaatatgctccagaaggcccggcagacccttgagttctacccctgtaccagcgaagagatcgatcatgaagatatcacgaaagataaaacatccaccgtcgaggcttgtctcccgctggagctgaccaagaacgagagctgtctgaatagccgggagacgtctttcatcacgaatggtagctgtctggccagcaggaaaacttccttcatgatggctctctgcctgagctctatctatgaagatctgaagatgtatcaggtggagtttaaaacaatgaacgccaaactcctgatggacccaaaaaggcaaatctttctggaccagaatatgctggccgtgatagacgagctgatgcaggcactgaacttcaacagcgagacggtgccacagaaatccagcctggaggagcctgacttttacaaaactaagatcaagctgtgtatcctgctgcacgcctttagaatccgtgccgtgactatcgacagggtgatgtcatacctcaacgcttcatgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 99 - DNA, 1829 bp, Artificial Sequence
  Synthetic: hIL12AB_002 (5UTR ORF  3UTR)
tcaagcttttggaccctcgtacagaagctaatacgactcactatagggaaataagagagaaaagaagagtaagaagaaatataagagccaccatgtgccaccagcagctggtgatcagctggttcagcctggtgttcctggccagccccctggtggccatctgggagctgaagaaggacgtgtacgtggtggagttggattggtaccccgacgcccccggcgagatggtggtgctgacctgcgacacccccgaggaggacggcatcacctggaccctggaccagagcagcgaggtgctgggcagcggcaagaccctgaccatccaggtgaaggagttcggcgacgccggccagtacacctgccacaagggcggcgaggtgctgagccacagcctgctgctgctgcacaagaaggaggacggcatctggagcaccgacatcctgaaggaccagaaggagcccaagaacaagaccttcctgagatgcgaggccaagaactacagcggcagattcacctgctggtggctgaccaccatcagcaccgacctgaccttcagcgtgaagagcagcagaggcagcagcgacccccagggcgtgacctgcggcgccgccaccctgagcgccgagagagtgagaggcgacaacaaggagtacgagtacagcgtggagtgccaggaagatagcgcctgccccgccgccgaggagagcctgcccatcgaggtgatggtggacgccgtgcacaagctgaagtacgagaactacaccagcagcttcttcatcagagatatcatcaagcccgacccccccaagaacctgcagctgaagcccctgaagaacagccggcaggtggaggtgagctgggagtaccccgacacctggagcaccccccacagctacttcagcctgaccttctgcgtgcaggtgcagggcaagagcaagagagagaagaaagatagagtgttcaccgacaagaccagcgccaccgtgatctgcagaaagaacgccagcatcagcgtgagagcccaagatagatactacagcagcagctggagcgagtgggccagcgtgccctgcagcggcggcggcggcggcggcagcagaaacctgcccgtggccacccccgaccccggcatgttcccctgcctgcaccacagccagaacctgctgagagccgtgagcaacatgctgcagaaggcccggcagaccctggagttctacccctgcaccagcgaggagatcgaccacgaagatatcaccaaagataagaccagcaccgtggaggcctgcctgcccctggagctgaccaagaacgagagctgcctgaacagcagagagaccagcttcatcaccaacggcagctgcctggccagcagaaagaccagcttcatgatggccctgtgcctgagcagcatctacgaggacctgaagatgtaccaggtggagttcaagaccatgaacgccaagctgctgatggaccccaagcggcagatcttcctggaccagaacatgctggccgtgatcgacgagctgatgcaggccctgaacttcaacagcgagaccgtgccccagaagagcagcctggaggagcccgacttctacaagaccaagatcaagctgtgcatcctgctgcacgccttcagaatcagagccgtgaccatcgacagagtgatgagctacctgaacgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 100 - DNA, 1829 bp, Artificial Sequence
  Synthetic: hIL12AB_003 (5UTR ORF  3UTR)
tcaagcttttggaccctcgtacagaagctaatacgactcactatagggaaataagagagaaaagaagagtaagaagaaatataagagccaccatgtgtcaccagcagttggtcatctcttggttttccctggtttttctggcatctcccctcgtggccatctgggaactgaagaaagacgtttacgttgtagaattggattggtatccggacgctcctggagaaatggtggtcctcacctgtgacacccctgaagaagacggaatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggtgacaacaaggagtatgagtactcagtggagtgccaggaagatagtgcctgcccagctgctgaggagagtctgcccattgaggtcatggtggatgccgttcacaagctcaagtatgaaaactacaccagcagcttcttcatcagagatatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacagataagacctcagccacggtcatctgccgcaaaaatgccagcattagcgtgcgggcccaggaccgctactatagctcatcttggagcgaatgggcatctgtgccctgcagtggcggagggggcggagggagcagaaacctccccgtggccactccagacccaggaatgttcccatgccttcaccactcccaaaacctgctgagggccgtcagcaacatgctccagaaggcccggcaaactttagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagatttgaagatgtaccaggtggagttcaagaccatgaatgcaaagcttctgatggatcctaagaggcagatctttttagatcaaaacatgctggcagttattgatgagctgatgcaggccctgaatttcaacagtgagacggtgccacaaaaatcctcccttgaagaaccagatttctacaagaccaagatcaagctctgcatacttcttcatgctttcagaattcgggcagtgactattgatagagtgatgagctatctgaatgcttcctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 101 - protein, 25 aa, Homo sapiens
  misc_feature (1)..(25): Human CD8A Transmembra ne Domain
IYIWAPLAGTCGVLLLSLVITLYCY

SEQ ID NO: 102 - protein, 25 aa, Homo sapiens
  misc_feature (1)..(25): Human PDGF-RB Transmembra ne domain
VVVISAILALVVLTIISLIILIMLW

SEQ ID NO: 103 - protein, 21 aa, Homo sapiens
  misc_feature (1)..(21): Human CD80 Transmembra ne domain
LLPSWAITLISVNGIFVICCL

SEQ ID NO: 104 - DNA, 1832 bp, Artificial Sequence
  Synthetic: hIL12AB_004 (5UTR ORF  3UTR)
tcaagcttttggaccctcgtacagaagctaatacgactcactatagggaaataagagagaaaagaagagtaagaagaaatataagagccaccatgggctgccaccagcagctggtcatcagctggttctccctggtcttcctggccagccccctggtggccatctgggagctgaagaaagacgtctacgtagtagagttggattggtacccagacgcacctggagaaatggtggttctcacctgtgacacgccagaagaagacggtatcacctggacgctggaccagagctcagaagttcttggcagtggaaaaacgctgaccatacaagtaaaagaatttggggatgctggccagtacacctgccacaaaggaggagaagttctcagccacagcctgctgctgctgcacaagaaagaagatggcatctggagcacagatattttaaaagaccagaaggagcccaagaacaaaaccttccttcgatgtgaggccaagaactacagtggccgcttcacctgctggtggctcaccaccatcagcacagacctcaccttctcggtgaagagcagccgtggcagctcagacccccaaggagtcacctgtggggcggccacgctgtcggcagaaagagttcgaggtgacaacaaggaatatgaatactcggtggaatgtcaagaagattcggcctgcccggcggcagaagaaagtcttcccatagaagtcatggtggatgctgttcacaaattaaaatatgaaaactacaccagcagcttcttcatcagagatatcatcaagccagacccgcccaagaacctgcagctgaagcccctgaagaacagccggcaggtggaagtttcctgggagtacccagatacgtggagcacgccgcacagctacttcagcctcaccttctgtgtacaagtacaaggcaagagcaagagagagaagaaagatcgtgtcttcacagataaaacctcggcgacggtcatctgcaggaagaatgcctccatctcggttcgagcccaggaccgctactacagcagcagctggagtgagtgggcctcggtgccctgcagtggtggcggcggcggcggcagcagaaaccttcctgtggccacgccggaccctggcatgttcccgtgcctgcaccacagccaaaatttacttcgagctgtttctaacatgctgcagaaagcacggcaaactttagaattctacccctgcacctcagaagaaatagaccatgaagatatcaccaaagataaaaccagcactgtagaggcctgcctgcccctggagctcaccaagaatgaatcctgcctcaacagcagagagaccagcttcatcaccaatggcagctgcctggccagcaggaaaaccagcttcatgatggcgctctgcctgagcagcatctatgaagatttgaagatgtaccaagtagaatttaaaaccatgaatgccaagctgctcatggaccccaagcggcagatatttttggatcaaaacatgctggctgtcattgatgagctcatgcaagcattaaacttcaactcagagacggtgccccagaagagcagcctggaggagccagatttctacaaaaccaagatcaagctctgcatcttattacatgccttccgcatccgggcggtcaccattgaccgtgtcatgtcctacttaaatgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 105 - DNA, 1829 bp, Artificial Sequence
  Synthetic: hIL12AB_005 (5UTR ORF  3UTR)
tcaagcttttggaccctcgtacagaagctaatacgactcactatagggaaataagagagaaaagaagagtaagaagaaatataagagccaccatgtgccaccagcagctggtcatcagctggttctccctggtcttcctggccagccccctggtggccatctgggagctgaagaaagacgtctacgtagtagagttggattggtacccagacgcacctggagaaatggtggttctcacctgtgacacgccagaagaagacggtatcacctggacgctggaccagagctcagaagttcttggcagtggaaaaacgctgaccatacaagtaaaagaatttggggatgctggccagtacacctgccacaaaggaggagaagttctcagccacagcctgctgctgctgcacaagaaagaagatggcatctggagcacagatattttaaaagaccagaaggagcccaagaacaaaaccttccttcgatgtgaggccaagaactacagtggccgcttcacctgctggtggctcaccaccatcagcacagacctcaccttctcggtgaagagcagccgtggcagctcagacccccaaggagtcacctgtggggcggccacgctgtcggcagaaagagttcgaggtgacaacaaggaatatgaatactcggtggaatgtcaagaagattcggcctgcccggcggcagaagaaagtcttcccatagaagtcatggtggatgctgttcacaaattaaaatatgaaaactacaccagcagcttcttcatcagagatatcatcaagccagacccgcccaagaacctgcagctgaagcccctgaagaacagccggcaggtggaagtttcctgggagtacccagatacgtggagcacgccgcacagctacttcagcctcaccttctgtgtacaagtacaaggcaagagcaagagagagaagaaagatcgtgtcttcacagataaaacctcggcgacggtcatctgcaggaagaatgcctccatctcggttcgagcccaggaccgctactacagcagcagctggagtgagtgggcctcggtgccctgcagtggtggcggcggcggcggcagcagaaaccttcctgtggccacgccggaccctggcatgttcccgtgcctgcaccacagccaaaatttacttcgagctgtttctaacatgctgcagaaagcacggcaaactttagaattctacccctgcacctcagaagaaatagaccatgaagatatcaccaaagataaaaccagcactgtagaggcctgcctgcccctggagctcaccaagaatgaatcctgcctcaacagcagagagaccagcttcatcaccaatggcagctgcctggccagcaggaaaaccagcttcatgatggcgctctgcctgagcagcatctatgaagatttgaagatgtaccaagtagaatttaaaaccatgaatgccaagctgctcatggaccccaagcggcagatatttttggatcaaaacatgctggctgtcattgatgagctcatgcaagcattaaacttcaactcagagacggtgccccagaagagcagcctggaggagccagatttctacaaaaccaagatcaagctctgcatcttattacatgccttccgcatccgggcggtcaccattgaccgtgtcatgtcctacttaaatgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 106 - DNA, 1829 bp, Artificial Sequence
  Synthetic: hIL12AB_006 (5UTR ORF  3UTR)
tcaagcttttggaccctcgtacagaagctaatacgactcactatagggaaataagagagaaaagaagagtaagaagaaatataagagccaccatgtgccaccagcagctggtgatcagctggttcagcctggtgttcctggccagccccctggtggccatctgggagctgaagaaggacgtgtacgtggtggagttggattggtaccccgacgcccccggcgagatggtggtgctgacctgtgacacccccgaggaggacggcatcacctggaccctggaccagagcagcgaggtgctgggcagcggcaagaccctgaccatccaggtgaaggagttcggggacgccggccagtacacctgccacaagggcggcgaggtgctgagccacagcctgctgctgctgcacaagaaggaggacggcatctggagcacagatatcctgaaggaccagaaggagcccaagaacaagaccttcctgagatgcgaggccaagaactacagcggcagattcacctgctggtggctgaccaccatcagcacagatttgaccttcagcgtgaagagcagcagaggcagcagcgacccccagggcgtgacctgcggcgccgccaccctgagcgccgagagagtgagaggtgacaacaaggagtacgagtacagcgtggagtgccaggaagatagcgcctgccccgccgccgaggagagcctgcccatcgaggtgatggtggacgccgtgcacaagctgaagtacgagaactacaccagcagcttcttcatcagagatatcatcaagcccgacccgccgaagaacctgcagctgaagcccctgaagaacagccggcaggtggaggtgagctgggagtaccccgacacctggagcaccccccacagctacttcagcctgaccttctgcgtgcaggtgcagggcaagagcaagagagagaagaaagatagagtgttcacagataagaccagcgccaccgtgatctgcagaaagaacgccagcatcagcgtgagagcccaagatagatactacagcagcagctggagcgagtgggccagcgtgccctgcagcggcggcggcggcggcggcagcagaaacctgcccgtggccacccccgaccccggcatgttcccctgcctgcaccacagccagaacctgctgagagccgtgagcaacatgctgcagaaggcccggcagaccctggagttctacccctgcaccagcgaggagatcgaccacgaagatatcaccaaagataagaccagcaccgtggaggcctgcctgcccctggagctgaccaagaatgaaagctgcctgaacagcagagagaccagcttcatcaccaacggcagctgcctggccagcagaaagaccagcttcatgatggccctgtgcctgagcagcatctacgaggacctgaagatgtaccaggtggagttcaagaccatgaacgccaagctgctgatggaccccaagcggcagatcttcctggaccagaacatgctggccgtgatcgacgagctgatgcaggccctgaacttcaacagcgagaccgtgccccagaagagcagcctggaggagcccgacttctacaagaccaagatcaagctgtgcatcctgctgcacgccttcagaatcagagccgtgaccatcgacagagtgatgagctacctgaacgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 107 - DNA, 1829 bp, Artificial Sequence
  Synthetic: hIL12AB_007 (5UTR ORF  3UTR)
tcaagcttttggaccctcgtacagaagctaatacgactcactatagggaaataagagagaaaagaagagtaagaagaaatataagagccaccatgtgccaccagcagcttgtcatctcctggttctctcttgtcttccttgcttctcctcttgtggccatctgggagctgaagaaggacgtttacgtagtggagttggattggtaccctgacgcacctggagaaatggtggttctcacctgtgacactcctgaggaggacggtatcacctggacgttggaccagtcttctgaggttcttggcagtggaaaaactcttactattcaggtgaaggagtttggagatgctggccagtacacctgccacaagggtggtgaagttctcagccacagtttacttcttcttcacaagaaggaggatggcatctggtctactgacattttaaaagaccagaaggagcccaagaacaaaacattccttcgttgtgaagccaagaactacagtggtcgtttcacctgctggtggcttactactatttctactgaccttactttctctgtgaagtcttctcgtggctcttctgaccctcagggtgtcacctgtggggctgctactctttctgctgagcgtgtgcgtggtgacaacaaggagtatgaatactcggtggagtgccaggaagattctgcctgccctgctgctgaggagtctcttcctattgaggtgatggtggatgctgtgcacaagttaaaatatgaaaactacacttcttctttcttcattcgtgacattataaaacctgaccctcccaagaaccttcagttaaaacctttaaaaaactctcgtcaggtggaggtgtcctgggagtaccctgacacgtggtctactcctcactcctacttctctcttactttctgtgtccaggtgcagggcaagtccaagcgtgagaagaaggaccgtgtcttcactgacaaaacatctgctactgtcatctgcaggaagaatgcatccatctctgtgcgtgctcaggaccgttactacagctcttcctggtctgagtgggcttctgtgccctgctctggcggcggcggcggcggcagcagaaatcttcctgtggctactcctgaccctggcatgttcccctgccttcaccactcgcagaaccttcttcgtgctgtgagcaacatgcttcagaaggctcgtcaaactttagaattctacccctgcacttctgaggagattgaccatgaagatatcaccaaagataaaacatctactgtggaggcctgccttcctttagagctgaccaagaatgaatcctgcttaaattctcgtgagacgtctttcatcaccaatggcagctgccttgcctcgcgcaaaacatctttcatgatggctctttgcctttcttccatctatgaagatttaaaaatgtaccaggtggagttcaagaccatgaatgcaaagcttctcatggaccccaagcgtcagatatttttggaccagaacatgcttgctgtcattgatgagctcatgcaggctttaaacttcaactctgagacggtgcctcagaagtcttctttagaagagcctgacttctacaagaccaagataaaactttgcattcttcttcatgctttccgcatccgtgctgtgactattgaccgtgtgatgtcctacttaaatgcttcttgataataggctggagcctcggtggccaagcttcttgccccttgggcctccccccagcccctcctccccttcctgcacccgtaccccccaaacaccattgtcacactccagtggtctttgaataaagtctgagtgggcggc

SEQ ID NO: 108 - DNA, 1829 bp, Artificial Sequence
  Synthetic: hIL12AB_008 (5UTR ORF  3UTR)
tcaagcttttggaccctcgtacagaagctaatacgactcactatagggaaataagagagaaaagaagagtaagaagaaatataagagccaccatgtgtcatcaacaactcgtgattagctggttcagtctcgtgttcctggcctctccgctggtggccatctgggagcttaagaaggacgtgtacgtggtggagctcgattggtaccccgacgcacctggcgagatggtggtgctaacctgcgatacccccgaggaggacgggatcacttggaccctggatcagagtagcgaagtcctgggctctggcaaaacactcacaatccaggtgaaggaattcggagacgctggtcagtacacttgccacaaggggggtgaagtgctgtctcacagcctgctgttactgcacaagaaggaggatgggatctggtcaaccgacatcctgaaggatcagaaggagcctaagaacaagacctttctgaggtgtgaagctaagaactattccggaagattcacttgctggtggttgaccacaatcagcactgacctgaccttttccgtgaagtccagcagaggaagcagcgatcctcagggcgtaacgtgcggcgcggctaccctgtcagctgagcgggttagaggcgacaacaaagagtatgagtactccgtggagtgtcaggaagatagcgcctgccccgcagccgaggagagtctgcccatcgaggtgatggtggacgctgtccataagttaaaatacgaaaattacacaagttcctttttcatccgcgatattatcaaacccgatccccccaagaacctgcagctgaagcccctgaagaatagccgacaggtggaagtctcttgggagtatcctgacacctggtccacgcctcacagctactttagtctgactttctgtgtccaggtccagggcaagagcaagagagagaaaaaggatagagtgtttactgacaaaacatctgctacagtcatctgcagaaagaacgccagtatctcagtgagggcgcaagatagatactacagtagtagctggagcgaatgggctagcgtgccctgttcagggggcggcggagggggctccaggaatctgcccgtggccacccccgaccctgggatgttcccttgcctccatcactcacagaacctgctcagagcagtgagcaacatgctccaaaaggcccgccagaccctggagttttacccttgtacttcagaagagatcgatcacgaagatataacaaaggataaaaccagcaccgtggaggcctgtctgcctctggaactcacaaagaatgaaagctgtctgaattccagggaaacctccttcattactaacggaagctgtctcgcatctcgcaaaacatcattcatgatggccctctgcctgtcttctatctatgaagatctcaagatgtatcaggtggagttcaaaacaatgaacgccaagctgctgatggaccccaagcggcagatcttcctggaccagaacatgctggcagtgatcgatgagctgatgcaagccttgaacttcaactcagagacggtgccgcaaaagtcctcgttggaggaaccagatttttacaaaaccaaaatcaagctgtgtatccttcttcacgcctttcggatcagagccgtgactatcgaccgggtgatgtcatacctgaatgcttcctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 109 - DNA, 1829 bp, Artificial Sequence
  Synthetic: hIL12AB_009 (5UTR ORF  3UTR)
tcaagcttttggaccctcgtacagaagctaatacgactcactatagggaaataagagagaaaagaagagtaagaagaaatataagagccaccatgtgccaccagcagctggtcatcagctggtttagcctggtcttcctggccagccccctggtggccatctgggagctgaagaaagacgtctacgtagtagagttggattggtacccagacgcacctggagaaatggtggttctcacctgcgacacgccagaagaagacggtatcacctggacgctggaccagagcagcgaagtactgggcagtggaaaaacgctgaccatacaagtaaaagaatttggcgatgctggccagtacacctgccacaaaggaggagaagtactgagccacagcctgctgctgctgcacaagaaagaagatggcatctggagcaccgacattttaaaagaccagaaggagcccaagaacaaaaccttccttcgatgtgaggcgaagaactacagtggccgcttcacctgctggtggctcaccaccatcagcaccgacctcaccttctcggtgaagagcagccgtggtagctcagacccccaaggagtcacctgtggggcggccacgctgtcggcagaaagagttcgaggcgacaacaaggaatatgaatactcggtggaatgtcaagaagattcggcctgcccggcggcagaagaaagtctgcccatagaagtcatggtggatgctgttcacaaattaaaatatgaaaactacaccagcagcttcttcatcagagatatcatcaagccagacccccccaagaacctgcagctgaagcccctgaagaacagccggcaggtggaagtttcctgggagtacccagatacgtggagcacgccgcacagctacttcagcctcaccttctgtgtacaagtacaaggcaagagcaagagagagaagaaagatcgtgtcttcaccgacaaaacctcggcgacggtcatctgcaggaagaatgcaagcatctcggttcgagcccaggaccgctactacagcagcagctggagtgagtgggcctcggtgccctgcagtggtggcggcggcggcggcagcagaaaccttcctgtggccacgccggaccctggcatgtttccgtgcctgcaccacagccaaaatttattacgagctgttagcaacatgctgcagaaagcacggcaaactttagaattctacccctgcacctcagaagaaatagaccatgaagatatcaccaaagataaaaccagcactgtagaggcctgcctgcccctggagctcaccaagaacgagagctgcctcaatagcagagagaccagcttcatcaccaatggcagctgcctggccagcaggaaaaccagcttcatgatggcgctctgcctgagcagcatctatgaagatctgaagatgtaccaagtagaatttaaaaccatgaatgccaagctgctcatggaccccaagcggcagatattcctcgaccaaaacatgctggctgtcattgatgagctcatgcaagcattaaacttcaactcagagacggtgccccagaagagcagcctggaggagccagatttctacaaaaccaagatcaagctctgcatcttattacatgccttccgcatccgggcggtcaccattgaccgtgtcatgtcctacttaaatgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 110 - DNA, 1829 bp, Artificial Sequence
  Synthetic: hIL12AB_010 (5UTR ORF  3UTR)
tcaagcttttggaccctcgtacagaagctaatacgactcactatagggaaataagagagaaaagaagagtaagaagaaatataagagccaccatgtgccaccagcagcttgtcatctcctggttttctcttgtcttcctcgcttctcctcttgtggccatctgggagctgaagaaagacgtctacgtagtagagttggattggtacccggacgctcctggagaaatggtggttctcacctgcgacactcctgaagaagacggtatcacctggacgctggaccaaagcagcgaagttttaggctctggaaaaacgctgaccatacaagtaaaagaatttggcgacgctggccagtacacgtgccacaaaggaggagaagttttaagccacagtttacttcttcttcacaagaaagaagatggcatctggagtacagatattttaaaagaccagaaggagcctaagaacaaaaccttcctccgctgtgaagctaagaactacagtggtcgtttcacctgctggtggctcaccaccatctccactgacctcaccttctctgtaaaatcaagccgtggttcttctgacccccaaggagtcacctgtggggctgccacgctcagcgctgaaagagttcgaggcgacaacaaggaatatgaatattctgtggaatgtcaagaagattctgcctgcccggcggcagaagaaagtcttcccatagaagtcatggtggacgctgttcacaaattaaaatatgaaaactacaccagcagcttcttcattcgtgacatcatcaaaccagaccctcctaagaaccttcagttaaaaccgctgaagaacagccggcaggtggaagtttcctgggagtacccagatacgtggagtacgccgcactcctacttcagtttaaccttctgtgtacaagtacaaggaaaatcaaaaagagagaagaaagatcgtgtcttcactgacaaaacatctgccacggtcatctgccgtaagaacgcttccatctcggttcgagcccaggaccgctactacagcagcagctggagtgagtgggcatctgttccctgcagtggtggcggcggcggcggcagccgcaaccttcctgtggccacgccggaccctggcatgttcccgtgccttcaccactcgcaaaatcttcttcgtgctgtttctaacatgctgcagaaggcgcggcaaactttagaattctacccgtgcacttctgaagaaatagaccatgaagatatcaccaaagataaaaccagcacggtggaggcctgccttcctttagaacttactaagaacgaaagttgccttaacagccgtgagaccagcttcatcaccaatggcagctgccttgctagcaggaagaccagcttcatgatggcgctgtgcctttcttccatctatgaagatcttaagatgtaccaagtagaatttaaaaccatgaatgccaaattattaatggaccccaagcggcagatattcctcgaccaaaacatgctggctgtcattgatgagctcatgcaagcattaaacttcaactcagaaactgttccccagaagtcatctttagaagaaccagatttctacaaaacaaaaataaaactctgcattcttcttcatgccttccgcatccgtgctgtcaccattgaccgtgtcatgtcctacttaaatgcttcttgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 111 - DNA, 1829 bp, Artificial Sequence
  Synthetic: hIL12AB_011 (5UTR ORF  3UTR)
tcaagcttttggaccctcgtacagaagctaatacgactcactatagggaaataagagagaaaagaagagtaagaagaaatataagagccaccatgtgccaccagcagctggtgatcagctggttcagcctggtgttcctggccagccccctggtggccatctgggagctgaagaaggacgtgtacgtggtggagttggattggtacccggacgcgccgggggagatggtggtgctgacgtgcgacacgccggaggaggacgggatcacgtggacgctggaccagagcagcgaggtgctggggagcgggaagacgctgacgatccaggtgaaggagttcggggacgcggggcagtacacgtgccacaaggggggggaggtgctgagccacagcctgctgctgctgcacaagaaggaggacgggatctggagcacagatatcctgaaggaccagaaggagccgaagaacaagacgttcctgaggtgcgaggcgaagaactacagcgggaggttcacgtgctggtggctgacgacgatcagcacggacctgacgttcagcgtgaagagcagcagggggagcagcgacccgcagggggtgacgtgcggggcggcgacgctgagcgcggagagggtgaggggtgacaacaaggagtacgagtacagcgtggagtgccaggaagatagcgcgtgcccggcggcggaggagagcctgccgatcgaggtgatggtggacgcggtgcacaagctgaagtacgagaactacacgagcagcttcttcatcagagatatcatcaagccggacccgccgaagaacctgcagctgaagccgctgaagaacagcaggcaggtggaggtgagctgggagtacccagatacgtggagcacgccgcacagctacttcagcctgacgttctgcgtgcaggtgcaggggaagagcaagagggagaagaaagatagggtgttcacagataagacgagcgcgacggtgatctgcaggaagaacgcgagcatcagcgtgagggcgcaagataggtactacagcagcagctggagcgagtgggcgagcgtgccgtgcagcggggggggggggggggggagcaggaacctgccggtggcgacgccggacccggggatgttcccgtgcctgcaccacagccagaacctgctgagggcggtgagcaacatgctgcagaaggcgaggcagacgctggagttctacccgtgcacgagcgaggagatcgaccacgaagatatcacgaaagataagacgagcacggtggaggcgtgcctgccgctggagctgacgaagaacgagagctgcctgaacagcagggagacgagcttcatcacgaacgggagctgcctggcgagcaggaagacgagcttcatgatggcgctgtgcctgagcagcatctacgaggacctgaagatgtaccaggtggagttcaagacgatgaacgcgaagctgctgatggacccgaagaggcagatcttcctggaccagaacatgctggcggtgatcgacgagctgatgcaggcgctgaacttcaacagcgagacggtgccgcagaagagcagcctggaggagccagatttctacaagacgaagatcaagctgtgcatcctgctgcacgcgttcaggatcagggcggtgacgatcgacagggtgatgagctacctgaacgcgagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 112 - DNA, 1829 bp, Artificial Sequence
  Synthetic: hIL12AB_012 (5UTR ORF  3UTR)
tcaagcttttggaccctcgtacagaagctaatacgactcactatagggaaataagagagaaaagaagagtaagaagaaatataagagccaccatgtgccatcagcagctggtgatcagctggttcagcctcgtgtttctggccagccccctggtggccatttgggaactcaagaaggacgtgtacgttgtggaactcgactggtaccctgacgccccaggcgaaatggtggtcttaacctgcgacacccctgaggaggacggaatcacctggaccttggaccagagctccgaggtcctcggcagtggcaagaccctgaccatacaggtgaaagaatttggagacgcagggcaatacacatgtcacaagggcggggaggttctttctcactcccttctgcttctacataaaaaggaagacggaatttggtctaccgacatcctcaaggaccaaaaggagcctaagaataaaaccttcttacgctgtgaagctaaaaactacagcggcagattcacttgctggtggctcaccaccatttctaccgacctgaccttctcggtgaagtcttcaaggggctctagtgatccacagggagtgacatgcggggccgccacactgagcgctgaacgggtgaggggcgataacaaggagtatgaatactctgtcgagtgtcaggaggattcagcttgtcccgcagctgaagagtcactccccatagaggttatggtcgatgctgtgcataaactgaagtacgaaaactacaccagcagcttcttcattagagatattataaaacctgacccccccaagaacctgcaacttaaacccctgaaaaactctcggcaggtcgaagttagctgggagtaccctgatacttggtccaccccccactcgtacttctcactgactttctgtgtgcaggtgcagggcaagagcaagagagagaaaaaagatcgtgtattcacagataagacctctgccaccgtgatctgcagaaaaaacgcttccatcagtgtcagagcccaagaccggtactatagtagtagctggagcgagtgggcaagtgtcccctgctctggcggcggagggggcggctctcgaaacctccccgtcgctacccctgatccaggaatgttcccttgcctgcatcactcacagaatctgctgagagcggtcagcaacatgctgcagaaagctaggcaaacactggagttttatccttgtacctcagaggagatcgaccacgaggatattaccaaagataagaccagcacggtggaggcctgcttgcccctggaactgacaaagaatgaatcctgccttaatagccgtgagacctcttttataacaaacggatcctgcctggccagcaggaagacctccttcatgatggccctctgcctgtcctcaatctacgaagacctgaagatgtaccaggtggaatttaaaactatgaacgccaagctgttgatggaccccaagcggcagatctttctggatcaaaatatgctggctgtgatcgacgaactgatgcaggccctcaactttaacagcgagaccgtgccacaaaagagcagtcttgaggagcccgacttctacaagaccaagatcaagctgtgcatcctccttcatgccttcaggataagagctgtcaccatcgacagagtcatgagttacctgaatgcatcctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 113 - DNA, 1829 bp, Artificial Sequence
  Synthetic: hIL12AB_013 (5UTR ORF  3UTR)
tcaagcttttggaccctcgtacagaagctaatacgactcactatagggaaataagagagaaaagaagagtaagaagaaatataagagccaccatgtgccaccagcagctggtcatctcctggttcagtcttgtcttcctggcctcgccgctggtggccatctgggagctgaagaaagacgtttacgtagtagagttggattggtacccagacgcacctggagaaatggtggtcctcacctgtgacacgccagaagaagacggtatcacctggacgctggaccagagcagtgaagttcttggaagtggaaaaacgctgaccatacaagtaaaagaatttggagatgctggccagtacacctgccacaaaggaggagaagttctcagccacagtttattattacttcacaagaaagaagatggcatctggtccacagatattttaaaagaccagaaggagcccaaaaataaaacatttcttcgatgtgaggccaagaactacagtggtcgtttcacctgctggtggctgaccaccatctccacagacctcaccttcagtgtaaaaagcagccgtggttcttctgacccccaaggagtcacctgtggggctgccacgctctctgcagaaagagttcgaggtgacaacaaagaatatgagtactcggtggaatgtcaagaagattcggcctgcccagctgctgaggagagtcttcccatagaagtcatggtggatgctgttcacaaattaaaatatgaaaactacaccagcagcttcttcatcagagatatcatcaaacctgacccgcccaagaacttacagctgaagccgctgaaaaacagccggcaggtagaagtttcctgggagtacccagatacctggtccacgccgcactcctacttctccctcaccttctgtgtacaagtacaaggcaagagcaagagagagaagaaagatcgtgtcttcacagataaaacatcagccacggtcatctgcaggaaaaatgccagcatctcggtgcgggcccaggaccgctactacagcagcagctggagtgagtgggcatctgtgccctgcagtggtggtgggggtggtggcagcagaaaccttcctgtggccactccagaccctggcatgttcccgtgccttcaccactcccaaaatttacttcgagctgtttctaacatgctgcagaaagcacggcaaactttagaattctacccgtgcacttctgaagaaattgaccatgaagatatcacaaaagataaaaccagcacagtggaggcctgtcttcctttagagctgaccaaaaatgaatcctgcctcaacagcagagagaccagcttcatcaccaatggcagctgcctggcctccaggaaaaccagcttcatgatggcgctctgcctcagctccatctatgaagatttgaagatgtaccaagtagaatttaaaaccatgaatgccaaattattaatggaccccaagaggcagatatttttagatcaaaacatgctggcagttattgatgagctcatgcaagcattaaacttcaacagtgagacggtacctcaaaaaagcagccttgaagagccagatttctacaaaaccaagatcaaactctgcattttacttcatgccttccgcatccgggcggtcaccattgaccgtgtcatgtcctacttaaatgcctcgtgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 114 - DNA, 1829 bp, Artificial Sequence
  Synthetic: hIL12AB_014 (5UTR ORF  3UTR)
tcaagcttttggaccctcgtacagaagctaatacgactcactatagggaaataagagagaaaagaagagtaagaagaaatataagagccaccatgtgccaccagcagcttgtgatttcttggttctctcttgtgttccttgcttctcctcttgtggctatttgggagttaaaaaaggacgtgtacgtggtggagcttgactggtaccctgacgcacctggcgagatggtggtgcttacttgtgacactcctgaggaggacggcattacttggacgcttgaccagtcttctgaggtgcttggctctggcaaaacacttactattcaggtgaaggagttcggggatgctggccagtacacttgccacaagggcggcgaggtgctttctcactctcttcttcttcttcacaagaaggaggacggcatttggtctactgacattttaaaagaccagaaggagcccaagaacaaaacattccttcgttgcgaggccaagaactactctggccgtttcacttgctggtggcttactactatttctactgaccttactttctctgtgaagtcttctcgtggctcttctgaccctcagggcgtgacttgtggggctgctactctttctgctgagcgtgtgcgtggtgacaacaaggagtacgagtactctgtggagtgccaggaagattctgcttgccctgctgctgaggagtctcttcctattgaggtgatggtggatgctgtgcacaagttaaaatacgagaactacacttcttctttcttcattcgtgacattattaagcctgaccctcccaagaaccttcagttaaaacctttaaaaaactctcgtcaggtggaggtgtcttgggagtaccctgacacttggtctactcctcactcttacttctctcttactttctgcgtgcaggtgcagggcaagtctaagcgtgagaagaaggaccgtgtgttcactgacaaaacatctgctactgtgatttgcaggaagaatgcatctatttctgtgcgtgctcaggaccgttactactcttcttcttggtctgagtgggcttctgtgccttgctctggcggcggcggcggcggctccagaaatcttcctgtggctactcctgaccctggcatgttcccttgccttcaccactctcagaaccttcttcgtgctgtgagcaacatgcttcagaaggctcgtcaaactcttgagttctacccttgcacttctgaggagattgaccacgaagatatcaccaaagataaaacatctactgtggaggcttgccttcctcttgagcttaccaagaatgaatcttgcttaaattctcgtgagacgtctttcatcaccaacggctcttgccttgcctcgcgcaaaacatctttcatgatggctctttgcctttcttctatttacgaagatttaaaaatgtaccaggtggagttcaaaacaatgaatgcaaagcttcttatggaccccaagcgtcagattttccttgaccagaacatgcttgctgtgattgacgagcttatgcaggctttaaatttcaactctgagacggtgcctcagaagtcttctcttgaggagcctgacttctacaagaccaagattaagctttgcattcttcttcatgctttccgtattcgtgctgtgactattgaccgtgtgatgtcttacttaaatgcttcttgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 115 - DNA, 1829 bp, Artificial Sequence
  Synthetic: hIL12AB_015 (5UTR ORF  3UTR)
tcaagcttttggaccctcgtacagaagctaatacgactcactatagggaaataagagagaaaagaagagtaagaagaaatataagagccaccatgtgtcaccagcagctggtgatcagctggtttagcctggtgtttctggccagccccctggtggccatctgggaactgaagaaagacgtgtacgtggtagaactggattggtatccggacgctcccggcgaaatggtggtgctgacctgtgacacccccgaagaagacggaatcacctggaccctggaccagagcagcgaggtgctgggcagcggcaaaaccctgaccatccaagtgaaagagtttggcgatgccggccagtacacctgtcacaaaggcggcgaggtgctaagccattcgctgctgctgctgcacaaaaaggaagatggcatctggagcaccgatatcctgaaggaccagaaagaacccaaaaataagacctttctaagatgcgaggccaagaattatagcggccgtttcacctgctggtggctgacgaccatcagcaccgatctgaccttcagcgtgaaaagcagcagaggcagcagcgacccccaaggcgtgacgtgcggcgccgccaccctgagcgccgagagagtgagaggcgacaacaaggagtatgagtacagcgtggagtgccaggaagatagcgcctgccccgccgccgaggagagcctgcccatcgaggtgatggtggatgccgtgcacaagctgaagtatgaaaactacaccagcagcttcttcatcagagatatcatcaaacccgacccccccaagaacctgcagctgaagcccctgaagaatagccggcaggtggaggtgagctgggagtaccccgacacctggagcaccccccatagctacttcagcctgaccttctgcgtgcaggtgcagggcaagagcaagagagaaaagaaagatagagtgttcacagataagaccagcgccacggtgatctgcagaaaaaatgccagcatcagcgtgagagcccaagatagatactatagcagcagctggagcgaatgggccagcgtgccctgcagcggcggcggcggcggcggcagcagaaacctgcccgtggccacccccgaccccggcatgttcccctgcctgcaccacagccaaaacctgctgagagccgtgagcaacatgctgcagaaggcccggcagaccctggaattttacccctgcaccagcgaagagatcgatcatgaagatatcaccaaagataaaaccagcaccgtggaggcctgtctgcccctggaactgaccaagaatgagagctgcctaaatagcagagagaccagcttcataaccaatggcagctgcctggccagcagaaagaccagctttatgatggccctgtgcctgagcagcatctatgaagacctgaagatgtaccaggtggagttcaagaccatgaatgccaagctgctgatggatcccaagcggcagatctttctggatcaaaacatgctggccgtgatcgatgagctgatgcaggccctgaatttcaacagcgagaccgtgccccaaaaaagcagcctggaagaaccggatttttataaaaccaaaatcaagctgtgcatactgctgcatgccttcagaatcagagccgtgaccatcgatagagtgatgagctatctgaatgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 116 - DNA, 1829 bp, Artificial Sequence
  Synthetic: hIL12AB_016 (5UTR ORF  3UTR)
tcaagcttttggaccctcgtacagaagctaatacgactcactatagggaaataagagagaaaagaagagtaagaagaaatataagagccaccatgtgccaccagcagctggtcatcagctggttcagcctggtcttcctggccagccccctggtggccatctgggagctgaagaaggacgtatacgtagtggagttggattggtacccagacgctcctggggagatggtggtgctgacctgtgacaccccagaagaggacggtatcacctggaccctggaccagagctcagaagtgctgggcagtggaaaaaccctgaccatccaggtgaaggagtttggagatgctggccagtacacctgccacaagggtggtgaagtgctgagccacagcctgctgctgctgcacaagaaggaggatggcatctggagcacagatatcctgaaggaccagaaggagcccaagaacaagaccttccttcgctgtgaagccaagaactacagtggccgcttcacctgctggtggctgaccaccatcagcacagacctcaccttctcggtgaagagcagcagaggcagctcagacccccagggtgtcacctgtggggcggccacgctgtcggcggagagagttcgaggtgacaacaaggagtatgaatactcggtggagtgccaggaagattcggcgtgcccggcggcagaagagagcctgcccatagaagtgatggtggatgctgtgcacaagctgaagtatgaaaactacaccagcagcttcttcatcagagatatcatcaagccagacccgcccaagaacctgcagctgaagcccctgaagaacagccggcaggtggaggtttcctgggagtacccagatacgtggagcaccccccacagctacttcagcctgaccttctgtgtccaggtgcagggcaagagcaagagagagaagaaagatagagtcttcacagataagacctcggccacggtcatctgcagaaagaatgcctccatctcggttcgagcccaagatagatactacagcagcagctggtcagaatgggcctcggtgccctgcagtggtggcggcggcggcggcagcagaaacctgcctgttgccaccccagaccctgggatgttcccctgcctgcaccacagccagaacttattacgagctgtttctaacatgctgcagaaggcccggcagaccctggagttctacccctgcacctcagaagagattgaccatgaagatatcaccaaagataagaccagcactgtagaggcctgcctgcccctggagctgaccaagaatgaaagctgcctgaacagcagagagaccagcttcatcaccaatggaagctgcctggccagcagaaagaccagcttcatgatggccctgtgcctgagcagcatctatgaagacctgaagatgtaccaggtggagttcaagaccatgaatgcaaagctgctgatggaccccaagcggcagatatttttggaccagaacatgctggctgtcattgatgagctgatgcaggccctgaacttcaactcagaaactgtaccccagaagagcagcctggaggagccagatttctacaagaccaagatcaagctgtgcatcctgcttcatgctttcagaatcagagctgtcaccattgaccgcgtgatgagctacttaaatgcctcgtgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 117 - DNA, 1829 bp, Artificial Sequence
  Synthetic: hIL12AB_017 (5UTR ORF  3UTR)
tcaagcttttggaccctcgtacagaagctaatacgactcactatagggaaataagagagaaaagaagagtaagaagaaatataagagccaccatgtgccaccagcagctggtaatcagctggttttccctcgtctttctggcatcacccctggtggctatctgggagctgaagaaggacgtgtacgtggtggagctggattggtaccctgacgccccgggggaaatggtggtgttaacctgcgacacgcctgaggaggacggcatcacctggacgctggaccagagcagcgaggtgcttgggtctggtaaaactctgactattcaggtgaaagagttcggggatgccggccaatatacttgccacaagggtggcgaggtgctttctcattctctgctcctgctgcacaagaaagaagatggcatttggtctactgatattctgaaagaccagaaggagcccaagaacaagacctttctgagatgcgaggctaaaaactacagcggaagatttacctgctggtggctgaccacaatctcaaccgacctgacattttcagtgaagtccagcagagggagctccgaccctcagggcgtgacctgcggagccgccactctgtccgcagaaagagtgagaggtgataataaggagtacgagtattcagtcgagtgccaagaagattctgcctgcccagccgccgaggagagcctgccaatcgaggtgatggtagatgcggtacacaagctgaagtatgagaactacacatcctccttcttcataagagatattatcaagcctgacccacctaaaaatctgcaactcaagcctttgaaaaattcacggcaggtggaggtgagctgggagtaccctgatacttggagcaccccccatagctacttttcgctgacattctgcgtccaggtgcagggcaagtcaaagagagagaagaaggatcgcgtgttcactgataaaacaagcgccacagtgatctgcagaaaaaacgctagcattagcgtcagagcacaggaccggtattactccagctcctggagcgaatgggcatctgtgccctgcagcggtgggggcggaggcggatccagaaacctccccgttgccacacctgatcctggaatgttcccctgtctgcaccacagccagaacctgctgagagcagtgtctaacatgctccagaaggccaggcagaccctggagttttacccctgcaccagcgaggaaatcgatcacgaagatatcaccaaagataaaacctccaccgtggaggcctgcctgcccctggaactgaccaaaaacgagagctgcctgaatagcagggagacctccttcatcaccaacggctcatgccttgccagccggaaaactagcttcatgatggccctgtgcctgtcttcgatctatgaggacctgaaaatgtaccaggtcgaatttaagacgatgaacgcaaagctgctgatggaccccaagcggcagatctttctggaccagaacatgctggcagtcatagatgagttgatgcaggcattaaacttcaacagcgagaccgtgcctcagaagtccagcctcgaggagccagatttttataagaccaagatcaaactatgcatcctgctgcatgctttcaggattagagccgtcaccatcgatcgagtcatgtcttacctgaatgctagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 118 - DNA, 1829 bp, Artificial Sequence
  Synthetic: hIL12AB_018 (5UTR ORF  3UTR)
tcaagcttttggaccctcgtacagaagctaatacgactcactatagggaaataagagagaaaagaagagtaagaagaaatataagagccaccatgtgtcaccaacagttagtaatctcctggttttctctggtgtttctggccagccccctcgtggccatctgggagcttaaaaaggacgtttacgtggtggagttggattggtatcccgacgctccaggcgaaatggtcgtgctgacctgcgatacccctgaagaagacggtatcacctggacgctggaccagtcttccgaggtgcttggatctggcaaaacactgacaatacaagttaaggagttcggggacgcagggcagtacacctgccacaaaggcggcgaggtcctgagtcactccctgttactgctccacaagaaagaggacggcatttggtccaccgacattctgaaggaccagaaggagcctaagaataaaactttcctgagatgcgaggcaaaaaactatagcggccgctttacttgctggtggcttacaacaatctctaccgatttaactttctccgtgaagtctagcagaggatcctctgacccgcaaggagtgacttgcggagccgccaccttgagcgccgaaagagtccgtggcgataacaaagaatacgagtactccgtggagtgccaggaagattccgcctgcccagctgccgaggagtccctgcccattgaagtgatggtggatgccgtccacaagctgaagtacgaaaactataccagcagcttcttcatccgggatatcattaagcccgaccctcctaaaaacctgcaacttaagcccctaaagaatagtcggcaggttgaggtcagctgggaatatcctgacacatggagcaccccccactcttatttctccctgaccttctgcgtgcaggtgcagggcaagagtaaacgggagaaaaaagatagggtctttaccgataaaaccagcgctacggttatctgtcggaagaacgcttccatctccgtccgcgctcaggatcgttactactcgtcctcatggagcgagtgggccagcgtgccctgcagcggcggcggtggaggcggatccagaaatctgcctgttgccacaccagaccctggcatgttcccctgtctgcatcatagccagaacctgctcagagccgtgagcaacatgctccagaaggccaggcaaactttggagttctacccgtgtacatctgaggaaatcgatcacgaagatataaccaaagataaaacctctacagtagaggcttgtttgcccctggagttgaccaaaaacgagagttgcctgaacagtcgcgagacgagcttcattactaacggcagctgtctcgcctccagaaaaacatccttcatgatggccctgtgtctttccagcatatacgaagacctgaaaatgtaccaggtcgagttcaaaacaatgaacgccaagctgcttatggaccccaagcggcagatcttcctcgaccaaaacatgctcgctgtgatcgatgagctgatgcaggctctcaacttcaattccgaaacagtgccacagaagtccagtctggaagaacccgacttctacaagaccaagattaagctgtgtattttgctgcatgcgtttagaatcagagccgtgaccattgatcgggtgatgagctacctgaacgcctcgtgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 119 - DNA, 1829 bp, Artificial Sequence
  Synthetic: hIL12AB_019 (5UTR ORF  3UTR)
tcaagcttttggaccctcgtacagaagctaatacgactcactatagggaaataagagagaaaagaagagtaagaagaaatataagagccaccatgtgccaccagcagcttgtcatctcctggttttctcttgtcttcctggcctcgccgctggtggccatctgggagctgaagaaagacgtttacgtagtagagttggattggtacccagacgcacctggagaaatggtggttctcacctgtgacactcctgaagaagacggtatcacctggacgctggaccaaagctcagaagttcttggcagtggaaaaacgctgaccatacaagtaaaagaatttggggatgctggccagtacacgtgccacaaaggaggagaagttctcagccacagtttacttcttcttcacaagaaagaagatggcatctggtccacagatattttaaaagaccagaaggagcccaagaacaaaaccttcctccgctgtgaggccaagaactacagtggtcgtttcacctgctggtggctcaccaccatctccactgacctcaccttctctgtaaaaagcagccgtggttcttctgacccccaaggagtcacctgtggggctgccacgctctcggcagaaagagttcgaggtgacaacaaggaatatgaatattctgtggaatgtcaagaagattctgcctgcccggcggcagaagaaagtcttcccatagaagtcatggtggatgctgttcacaaattaaaatatgaaaactacaccagcagcttcttcattcgtgacatcatcaaaccagacccgcccaagaaccttcagttaaaacctttaaaaaacagccggcaggtagaagtttcctgggagtacccagatacgtggtccacgccgcactcctacttcagtttaaccttctgtgtacaagtacaaggaaaatcaaaaagagagaagaaagatcgtgtcttcactgacaaaacatctgccacggtcatctgcaggaagaatgcctccatctcggttcgagcccaggaccgctactacagcagcagctggagtgagtgggcatctgttccctgcagtggtggcggcggcggcggcagccgcaaccttcctgtggccacgccggaccctggcatgttcccgtgccttcaccactcccaaaatcttcttcgtgctgtttctaacatgctgcagaaggcgcgccaaactttagaattctacccgtgcacttctgaagaaatagaccatgaagatatcaccaaagataaaaccagcacggtggaggcctgccttcctttagagctgaccaagaatgaatcctgcctcaacagcagagagaccagcttcatcaccaatggcagctgcctggcctcgcgcaagaccagcttcatgatggcgctgtgcctttcttccatctatgaagatttaaagatgtaccaagtagaatttaaaaccatgaatgccaaattattaatggaccccaaacggcagatatttttggatcaaaacatgctggctgtcattgatgagctcatgcaagcattaaacttcaactcagaaactgttccccagaagtcatctttagaagagccagatttctacaaaacaaaaataaaactctgcattcttcttcatgccttccgcatccgtgctgtcaccattgaccgtgtcatgtcctacttaaatgcttcttgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 120 - DNA, 1829 bp, Artificial Sequence
  Synthetic: hIL12AB_020 (5UTR ORF  3UTR)
tcaagcttttggaccctcgtacagaagctaatacgactcactatagggaaataagagagaaaagaagagtaagaagaaatataagagccaccatgtgccaccagcagctggtgatcagctggttcagcctggtgttcctggctagccctctggtggccatctgggagctgaagaaggacgtgtacgtggtggagttggattggtaccccgacgctcccggcgagatggtggtgctgacctgcgacacccccgaggaggacgggatcacctggaccctggatcagtcaagcgaggtgctgggaagcggcaagaccctgaccatccaggtgaaggagttcggcgacgccggccaatacacttgccacaagggaggcgaggtgctgtcccactccctcctgctgctgcacaaaaaggaagacggcatctggagcaccgacatcctgaaagaccagaaggagcctaagaacaaaacattcctcagatgcgaggccaagaattactccgggagattcacctgttggtggctgaccaccatcagcacagacctgaccttcagcgtgaagagcagcagaggcagcagcgacccccagggcgtgacctgtggcgccgccaccctgagcgccgaaagagtgcgcggcgacaacaaggagtacgagtactccgtggaatgccaggaagatagcgcctgccccgccgccgaggagagcctgcccatcgaggtgatggtggacgccgtccacaagctgaagtacgagaactacacctctagcttcttcatcagagatatcatcaagcccgatccccccaagaacctgcagctgaaacccctgaagaacagccggcaggtggaggtgagctgggagtatcccgacacctggtccaccccccacagctattttagcctgaccttctgcgtgcaagtgcagggcaagagcaagagagagaagaaggaccgcgtgttcaccgacaaaaccagcgccaccgtgatctgcagaaagaacgccagcatcagcgtgagggcccaggatagatactacagttccagctggagcgagtgggccagcgtgccctgcagcggcggcggcgggggaggctcgagaaacctgcccgtggctacccccgatcccggaatgttcccctgcctgcaccacagccagaacctgctgagggcggtgtccaacatgcttcagaaggcccggcagaccctggagttctacccctgtacctctgaggagatcgatcatgaagatatcacaaaagataaaaccagcaccgtggaggcctgcctgcccctggagctgaccaagaacgagagctgcctgaactcccgcgagaccagcttcatcacgaacggcagctgcctggccagcaggaagacctccttcatgatggccctgtgcctgagcagcatctacgaggacctgaaaatgtaccaggtggagtttaagaccatgaacgccaagctgctgatggaccccaagcggcaaatcttcctggaccagaacatgctggcagtgatcgacgagctcatgcaggccctgaacttcaatagcgagacggtcccccagaagagcagcctggaggagcccgacttttacaagaccaagatcaagctgtgcatcctgctgcacgcctttagaatccgtgccgtgaccattgacagagtgatgagctacctgaatgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 121 - DNA, 1829 bp, Artificial Sequence
  Synthetic: hIL12AB_021 (5UTR ORF  3UTR)
tcaagcttttggaccctcgtacagaagctaatacgactcactatagggaaataagagagaaaagaagagtaagaagaaatataagagccaccatgtgccaccagcagctggtgatcagctggttcagcctggtgttcctggccagccctctggttgccatctgggagctgaagaaagacgtgtacgtcgtggaactggactggtatccggacgccccgggcgagatggtggtgctgacctgtgacacccccgaggaggacggcatcacctggacgctggaccaatcctccgaggtgctgggaagcggcaagaccctgaccatccaggtgaaggaattcggggacgccgggcagtacacctgccacaaggggggcgaagtgctgtcccactcgctgctgctcctgcataagaaggaggatggaatctggtccaccgacatcctcaaagatcagaaggagcccaagaacaagacgttcctgcgctgtgaagccaagaattattcggggcgattcacgtgctggtggctgacaaccatcagcaccgacctgacgtttagcgtgaagagcagcagggggtccagcgacccccagggcgtgacgtgcggcgccgccaccctctccgccgagagggtgcggggggacaataaggagtacgagtacagcgtggaatgccaggaggacagcgcctgccccgccgcggaggaaagcctcccgatagaggtgatggtggacgccgtgcacaagctcaagtatgagaattacaccagcagctttttcatccgggacattatcaagcccgaccccccgaagaacctccagctgaagcccctgaagaacagccggcaggtggaagtctcctgggagtatcccgacacctggagcaccccgcacagctacttctccctgaccttctgtgtgcaggtgcagggcaagtccaagagggaaaagaaggacagggttttcaccgacaagaccagcgcgaccgtgatctgccggaagaacgccagcataagcgtccgcgcccaagataggtactacagcagctcctggagcgagtgggctagcgtgccctgcagcgggggcgggggtgggggctccaggaacctgccagtggcgacccccgaccccggcatgttcccctgcctccatcacagccagaacctgctgagggccgtcagcaatatgctgcagaaggccaggcagaccctggaattctacccctgcacgtcggaggagatcgatcacgaggatatcacaaaagacaagacttccaccgtggaggcctgcctgcccctggagctcaccaagaatgagtcctgtctgaactcccgggaaaccagcttcatcaccaacgggtcctgcctggccagcaggaagaccagctttatgatggccctgtgcctgtcgagcatctacgaggacctgaagatgtaccaggtcgagttcaagacaatgaacgccaagctgctgatggaccccaagaggcaaatcttcctggaccagaatatgcttgccgtcatcgacgagctcatgcaggccctgaacttcaactccgagaccgtgccccagaagagcagcctggaggagcccgacttctacaagaccaagatcaagctgtgcatcctgctgcacgcgttcaggatccgggcagtcaccatcgaccgtgtgatgtcctacctgaacgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 122 - DNA, 1829 bp, Artificial Sequence
  Synthetic: hIL12AB_022 (5UTR ORF  3UTR)
tcaagcttttggaccctcgtacagaagctaatacgactcactatagggaaataagagagaaaagaagagtaagaagaaatataagagccaccatgtgccatcagcagctggtgatcagctggttcagcctggtgttcctcgcctctcccctggtggccatctgggagctcaaaaaggacgtgtacgtggtggagctcgactggtacccagacgcccccggggagatggtggtgctgacctgcgacacccccgaagaagacggcatcacgtggaccctcgaccagtccagcgaggtgctggggagcgggaagactctgaccatccaggtcaaggagttcggggacgccgggcagtacacgtgccacaagggcggcgaagtcttaagccacagcctgctcctgctgcacaagaaggaggacgggatctggtccacagacatactgaaggaccagaaggagccgaagaataaaacctttctgaggtgcgaggccaagaactattccggcaggttcacgtgctggtggcttacaacaatcagcacagacctgacgttcagcgtgaagtccagccgcggcagcagcgacccccagggggtgacctgcggcgccgccaccctgagcgccgagcgggtgcgcggggacaacaaggagtacgagtactccgtggagtgccaggaagacagcgcctgtcccgccgccgaagagagcctgcctatcgaggtcatggtagatgcagtgcataagctgaagtacgagaactatacgagcagctttttcatacgcgacatcatcaagcccgacccccccaagaacctgcagcttaagcccctgaagaatagccggcaggtggaggtctcctgggagtaccccgacacctggtcaacgccccacagctacttctccctgaccttttgtgtccaagtccagggaaagagcaagagggagaagaaagatcgggtgttcaccgacaagacctccgccacggtgatctgcaggaagaacgccagcatctccgtgagggcgcaagacaggtactactccagcagctggtccgaatgggccagcgtgccctgctccggcggcgggggcggcggcagccgaaacctacccgtggccacgccggatcccggcatgtttccctgcctgcaccacagccagaacctcctgagggccgtgtccaacatgctgcagaaggccaggcagactctggagttctacccctgcacgagcgaggagatcgatcacgaggacatcaccaaggataagaccagcactgtggaggcctgccttcccctggagctgaccaagaacgagagctgtctgaactccagggagacctcattcatcaccaacggctcctgcctggccagcaggaaaaccagcttcatgatggccttgtgtctcagctccatctacgaggacctgaagatgtatcaggtcgagttcaagacaatgaacgccaagctgctgatggaccccaaaaggcagatcttcctggaccagaacatgctggccgtcatcgacgagctgatgcaggccctgaacttcaacagcgagacggtgccccagaaaagctccctggaggagcccgacttctacaagaccaagatcaagctgtgcatcctgctgcacgccttcaggatcagggcagtgaccatcgaccgggtgatgtcataccttaacgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 123 - DNA, 1829 bp, Artificial Sequence
  Synthetic: hIL12AB_023 (5UTR ORF  3UTR)
tcaagcttttggaccctcgtacagaagctaatacgactcactatagggaaataagagagaaaagaagagtaagaagaaatataagagccaccatgtgccatcagcagctggtgatctcctggttcagcctggtgtttctggcctcgcccctggtcgccatctgggagctgaagaaagacgtgtacgtcgtcgaactggactggtaccccgacgcccccggggagatggtggtgctgacctgcgacacgccggaggaggacggcatcacctggaccctggatcaaagcagcgaggtgctgggcagcggcaagaccctgaccatccaagtgaaggaattcggcgatgccggccagtacacctgtcacaaagggggcgaggtgctcagccacagcctgctgctgctgcacaagaaggaggatggcatctggagcaccgatatcctgaaggaccagaaagagcccaagaacaagacgttcctgaggtgcgaggccaagaactacagcggtaggttcacgtgttggtggctgaccaccatcagcaccgacctgacgttcagcgtgaagagctccaggggcagctccgacccacagggggtgacgtgcggggccgcaaccctcagcgccgaaagggtgcggggggacaacaaggagtacgaatactccgtggagtgccaggaagattcggcctgccccgccgcggaggagagcctccccatcgaggtaatggtggacgccgtgcataagctgaagtacgagaactacaccagctcgttcttcatccgagacatcatcaaacccgacccgcccaaaaatctgcagctcaagcccctgaagaactccaggcaggtggaggtgagctgggagtaccccgacacctggtccaccccgcacagctacttctccctgacattctgcgtgcaggtgcagggcaagagcaagcgggagaagaaggacagggtgttcaccgacaagacgagcgccaccgtgatctgccgaaagaacgccagcatctcggtgcgcgcccaggataggtactattccagctcctggagcgagtgggcctcggtaccctgcagcggcggcgggggcggcggcagtaggaatctgcccgtggctaccccggacccgggcatgttcccctgcctccaccacagccagaacctgctgagggccgtgagcaacatgctgcagaaggccagacagacgctggagttctacccctgcacgagcgaggagatcgaccacgaggacatcaccaaggataaaacttccaccgtcgaggcctgcctgcccttggagctgaccaagaatgaatcctgtctgaacagcagggagacctcgtttatcaccaatggcagctgcctcgcctccaggaagaccagcttcatgatggccctctgtctgagctccatctatgaggacctgaagatgtaccaggtggagttcaagaccatgaacgcgaagctgctgatggaccccaagaggcagatcttcctggatcagaatatgctggcggtgatcgacgagctcatgcaggccctcaatttcaatagcgagacagtgccccagaagtcctccctggaggagcccgacttctacaagaccaagatcaagctgtgtatcctgctgcacgccttccggatccgggccgtcaccatcgaccgggtcatgagctacctcaatgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 124 - DNA, 1829 bp, Artificial Sequence
  Synthetic: hIL12AB_024 (5UTR ORF  3UTR)
tcaagcttttggaccctcgtacagaagctaatacgactcactatagggaaataagagagaaaagaagagtaagaagaaatataagagccaccatgtgccaccagcagctggtgatctcctggttctccctggtgttcctggcctcgcccctggtggccatctgggagctgaagaaggacgtgtacgtcgtggagctcgactggtaccccgacgcccctggcgagatggtggtgctgacctgcgacaccccagaggaggatggcatcacctggaccctggatcagtcctccgaggtgctgggctccggcaagacgctgaccatccaagtgaaggagttcggtgacgccggacagtatacctgccataagggcggcgaggtcctgtcccacagcctcctcctcctgcataagaaggaggacggcatctggagcaccgacatcctgaaggaccagaaggagcccaagaacaagacctttctgaggtgcgaggccaagaactacagcggccgattcacctgctggtggctcaccaccatatccaccgacctgactttctccgtcaagtcctcccgggggtccagcgacccccagggagtgacctgcggcgccgccaccctcagcgccgagcgggtgcggggggacaacaaggagtacgaatactccgtcgagtgccaggaggactccgcctgcccggccgccgaggagagcctgcccatcgaggtgatggtcgacgcggtgcacaagctgaagtacgagaactacaccagcagtttcttcatcagggatatcatcaagccagatcccccgaagaatctgcaactgaagccgctgaaaaactcacgacaggtggaggtgagctgggagtaccccgacacgtggagcaccccacattcctacttcagcctgaccttctgcgtgcaggtccagggcaagagcaagcgggagaagaaggacagggtgttcacggataagaccagtgccaccgtgatctgcaggaagaacgcctctattagcgtgagggcccaggatcggtattactcctcgagctggagcgaatgggcctccgtgccctgcagtggggggggtggaggcgggagcaggaacctgcccgtagcaacccccgaccccgggatgttcccctgtctgcaccactcgcagaacctgctgcgcgcggtgagcaacatgctccaaaaagcccgtcagaccttagagttctacccctgcaccagcgaagaaatcgaccacgaagacatcaccaaggacaaaaccagcaccgtggaggcgtgcctgccgctggagctgaccaagaacgagagctgcctcaactccagggagaccagctttatcaccaacggctcgtgcctagccagccggaaaaccagcttcatgatggccctgtgcctgagctccatttacgaggacctgaagatgtatcaggtggagttcaagaccatgaatgccaaactcctgatggaccccaagaggcagatcttcctggaccagaacatgctcgcggtgatcgatgagctgatgcaggccctgaactttaatagcgagaccgtgccccagaaaagcagcctggaggagccggacttctacaagaccaaaatcaagctgtgcatcctgctccacgccttccgcatccgggccgtgaccatcgacagggtgatgagctacctgaacgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 125 - DNA, 1829 bp, Artificial Sequence
  Synthetic: hIL12AB_025 (5UTR ORF  3UTR)
tcaagcttttggaccctcgtacagaagctaatacgactcactatagggaaataagagagaaaagaagagtaagaagaaatataagagccaccatgtgccatcagcagctggtgatttcctggttctccctggtgttcctggccagccccctcgtggcgatctgggagctaaagaaggacgtgtacgtggtggagctggactggtacccggacgcacccggcgagatggtcgttctgacctgcgatacgccagaggaggacggcatcacctggaccctcgatcagagcagcgaggtcctggggagcggaaagaccctgaccatccaggtcaaggagttcggcgacgccggccagtacacctgccacaaaggtggcgaggtcctgagccactcgctgctgctcctgcataagaaggaggacggaatctggagcacagacatcctgaaagaccagaaggagcccaagaacaagaccttcctgaggtgcgaggccaagaactacagcgggcgcttcacgtgctggtggctgaccaccatcagcacggacctcaccttctccgtgaagagcagccggggatccagcgatccccaaggcgtcacctgcggcgcggccaccctgagcgcggagagggtcaggggcgataataaggagtatgagtacagcgtggagtgccaggaggacagcgcctgcccggccgccgaggagtccctgccaatcgaagtgatggtcgacgccgtgcacaagctgaagtacgagaactacaccagcagcttcttcatccgggatatcatcaagcccgatcccccgaagaacctgcagctgaagcccctcaagaacagccggcaggtggaggtgagttgggagtaccccgacacctggtcaacgccccacagctacttctccctgaccttctgtgtgcaggtgcagggaaagagcaagagggagaagaaagaccgggtcttcaccgacaagaccagcgccacggtgatctgcaggaagaacgcaagcatctccgtgagggcccaggacaggtactacagctccagctggtccgaatgggccagcgtgccctgtagcggcggcgggggcggtggcagccgcaacctcccagtggccacccccgaccccggcatgttcccctgcctgcaccacagccagaatctgctgagggccgtgagtaacatgctgcagaaggcaaggcaaaccctcgaattctatccctgcacctccgaggagatcgaccacgaggatatcaccaaggacaagaccagcaccgtcgaggcctgtctccccctggagctgaccaagaatgagagctgcctgaacagccgggagaccagcttcatcaccaacgggagctgcctggcctccaggaagacctcgttcatgatggcgctgtgcctctcaagcatatacgaggatctgaagatgtaccaggtggagtttaagacgatgaacgccaagctgctgatggacccgaagaggcagatcttcctggaccagaacatgctggccgtgatagacgagctcatgcaggccctgaacttcaactccgagaccgtgccgcagaagtcatccctcgaggagcccgacttctataagaccaagatcaagctgtgcatcctgctccacgccttccggataagggccgtgacgatcgacagggtgatgagctaccttaacgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 126 - DNA, 1829 bp, Artificial Sequence
  Synthetic: hIL12AB_026 (5UTR ORF  3UTR)
tcaagcttttggaccctcgtacagaagctaatacgactcactatagggaaataagagagaaaagaagagtaagaagaaatataagagccaccatgtgccaccagcagctcgtgatcagctggttctccctggtgtttctcgccagccccctggtggccatctgggagctgaagaaggacgtgtacgtggtggagctggactggtaccctgacgccccgggggagatggtcgtgctgacctgcgacacccccgaagaggacggtatcacctggaccctggaccagtccagcgaggtgctgggcagcggcaagaccctgactattcaagtcaaggagttcggagacgccggccagtacacctgccacaagggtggagaggtgttatcacacagcctgctgctgctgcacaagaaggaagacgggatctggagcaccgacatcctgaaggaccagaaggagcccaaaaacaagaccttcctgcggtgcgaggccaagaactattcgggccgctttacgtgctggtggctgaccaccatcagcactgatctcaccttcagcgtgaagtcctcccgggggtcgtccgacccccagggggtgacctgcggggccgccaccctgtccgccgagagagtgaggggcgataataaggagtacgagtacagcgttgagtgccaggaagatagcgcctgtcccgccgccgaggagagcctgcccatcgaggtgatggtggacgccgtccacaagctgaagtatgagaactacacctcaagcttcttcatcagggacatcatcaaacccgatccgcccaagaatctgcagctgaagcccctgaaaaatagcaggcaggtggaggtgagctgggagtaccccgacacctggtccaccccccatagctatttctccctgacgttctgcgtgcaggtgcaagggaagagcaagcgggagaagaaggaccgggtgttcaccgacaagacctccgccaccgtgatctgtaggaagaacgcgtcgatctcggtcagggcccaggacaggtattacagcagcagctggagcgagtgggcgagcgtgccctgctcgggcggcggcggcggcgggagcagaaatctgcccgtggccaccccagaccccggaatgttcccctgcctgcaccattcgcagaacctcctgagggccgtgagcaacatgctgcagaaggcccgccagacgctggagttctacccctgcacgagcgaggagatcgaccacgaagacatcaccaaggacaaaaccagcaccgtggaggcctgcctgcccctggagctgaccaaaaacgaatcctgcctcaacagccgggagaccagcttcatcaccaacggcagctgcctggccagccgaaagacctccttcatgatggccctctgcctgagcagcatctatgaggatctgaagatgtatcaggtggagttcaagaccatgaatgccaagctgctgatggaccccaagaggcagatattcctggaccagaatatgctggccgtgatcgacgagctgatgcaggccctgaacttcaacagcgagaccgtcccccagaagtccagcctggaggagccggacttttacaaaacgaagatcaagctgtgcatactgctgcacgccttcaggatccgggccgtgacaatcgacagggtgatgtcctacctgaacgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 127 - DNA, 1829 bp, Artificial Sequence
  Synthetic: hIL12AB_027 (5UTR ORF  3UTR)
tcaagcttttggaccctcgtacagaagctaatacgactcactatagggaaataagagagaaaagaagagtaagaagaaatataagagccaccatgtgtcaccagcagctggtgatcagctggttctccctggtgttcctggccagccccctggtggccatctgggagctcaagaaggacgtctacgtcgtggagctggattggtaccccgacgctcccggggagatggtggtgctgacctgcgacacccccgaggaggacggcatcacctggacgctggaccagagctcagaggtgctgggaagcggaaagacactgaccatccaggtgaaggagttcggggatgccgggcagtatacctgccacaagggcggcgaagtgctgagccattccctgctgctgctgcacaagaaggaggacggcatatggtccaccgacatcctgaaggatcagaaggagccgaagaataaaaccttcctgaggtgcgaggccaagaattacagcggccgattcacctgctggtggctgaccaccatcagcaccgacctgaccttcagtgtgaagtcctcacggggcagctcagatccccagggcgtgacctgcggggccgcgacactcagcgccgagcgggtgaggggtgataacaaggagtacgagtattctgtggagtgccaggaagactccgcctgtcccgccgccgaggagtccctgcccatcgaggtgatggtggacgccgtgcataaactgaagtacgagaactacacctccagcttcttcatccgggatataatcaagcccgaccctccgaaaaacctgcagctgaagccccttaaaaacagccggcaggtggaggtgagctgggagtaccccgacacctggagcaccccccatagctatttcagcctgaccttctgcgtgcaggtgcaggggaagtccaagcgcgagaaaaaggaccgggtgttcaccgacaagacgagcgccaccgtgatctgccggaagaacgccagtataagcgtaagggcccaggataggtactacagctccagctggtcggagtgggcctccgtgccctgttccggcggcggggggggtggcagcaggaacctccccgtggccacgccggaccccggcatgttcccgtgcctgcaccactcccaaaacctcctgcgggccgtcagcaacatgctgcaaaaggcgcggcagaccctggagttttacccctgtacctccgaagagatcgaccacgaggatatcaccaaggataagacctccaccgtggaggcctgtctccccctggagctgaccaagaacgagagctgtcttaacagcagagagacctcgttcataacgaacggctcctgcctcgcttccaggaagacgtcgttcatgatggcgctgtgcctgtccagcatctacgaggacctgaagatgtatcaggtcgagttcaaaaccatgaacgccaagctgctgatggaccccaagaggcagatcttcctggaccagaacatgctcgccgtgatcgacgagctgatgcaggccctgaacttcaacagcgaaaccgtgccccagaagtcaagcctggaggagccggacttctataagaccaagatcaagctgtgtatcctgctacacgcttttcgtatccgggccgtgaccatcgacagggttatgtcgtacttgaacgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 128 - DNA, 1829 bp, Artificial Sequence
  Synthetic: hIL12AB_028 (5UTR ORF  3UTR)
tcaagcttttggaccctcgtacagaagctaatacgactcactatagggaaataagagagaaaagaagagtaagaagaaatataagagccaccatgtgccaccaacagctcgtgatcagctggttcagcctggtgttcctggccagcccgctggtggccatctgggagctgaagaaggacgtgtacgtggtggagctggactggtaccccgacgcccccggcgagatggtggtcctgacctgcgacacgccggaagaggacggcatcacctggaccctggatcagtccagcgaggtgctgggctccggcaagaccctgaccattcaggtgaaggagttcggcgacgccggtcagtacacctgccacaagggcggcgaggtgctgagccacagcctactgctcctgcacaaaaaggaggatggaatctggtccaccgacatcctcaaggaccagaaggagccgaagaacaagacgttcctccggtgcgaggccaagaactacagcggcaggtttacctgctggtggctgaccaccatcagcaccgacctgacattttccgtgaagagcagccgcggcagcagcgatccccagggcgtgacctgcggggcggccaccctgtccgccgagcgtgtgaggggcgacaacaaggagtacgagtacagcgtggaatgccaggaggacagcgcctgtcccgccgccgaggagagcctgccaatcgaggtcatggtggacgccgtgcacaagctgaagtacgagaactacacgagcagcttcttcatcagggacatcatcaaaccggacccgcccaagaacctgcagctgaaacccttgaaaaacagcaggcaggtggaagtgtcttgggagtaccccgacacctggtccaccccccacagctactttagcctgaccttctgtgtgcaggtccagggcaagtccaagagggagaagaaggacagggtgttcaccgacaaaaccagcgccaccgtgatctgcaggaagaacgcctccatcagcgtgcgggcccaggacaggtattacagctcgtcgtggagcgagtgggccagcgtgccctgctccgggggaggcggcggcggaagccggaatctgcccgtggccacccccgatcccggcatgttcccgtgtctgcaccacagccagaacctgctgcgggccgtgagcaacatgctgcagaaggcccgccaaaccctggagttctacccctgtacaagcgaggagatcgaccatgaggacattaccaaggacaagaccagcaccgtggaggcctgcctgcccctcgagctcacaaagaacgaatcctgcctgaatagccgcgagaccagctttatcacgaacgggtcctgcctcgccagccggaagacaagcttcatgatggccctgtgcctgagcagcatctacgaggacctgaaaatgtaccaagtggagttcaaaacgatgaacgccaagctgctgatggaccccaagcgccagatcttcctggaccagaacatgctggccgtcatcgacgagctcatgcaggccctgaacttcaacagcgagaccgtgccccagaagagcagcctggaggagcccgacttctacaagacgaagatcaagctctgcatcctgctgcacgctttccgcatccgcgcggtgaccatcgaccgggtgatgagctacctcaacgccagttgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 129 - DNA, 1829 bp, Artificial Sequence
  Synthetic: hIL12AB_029 (5UTR ORF  3UTR)
tcaagcttttggaccctcgtacagaagctaatacgactcactatagggaaataagagagaaaagaagagtaagaagaaatataagagccaccatgtgccaccaacagctggtgatcagctggttcagcctggtgtttctggcctcccctctggtggccatctgggagctgaagaaggacgtgtacgtggtggagctggactggtaccctgacgcccccggcgaaatggtggtgctgacgtgcgacacccccgaggaggatggcatcacctggaccctggaccaaagcagcgaggtcctcggaagcggcaagaccctcactatccaagtgaaggagttcggggatgcgggccagtacacctgccacaagggcggcgaggtgctgtctcatagcctgctgctcctgcataagaaggaagacggcatctggagcaccgacatactgaaggatcagaaggagcccaagaacaagaccttcctgaggtgcgaggccaagaactactccgggcgcttcacctgttggtggctgaccaccatctccaccgacctgaccttcagcgtgaagagcagcagggggagcagcgacccccagggggtgacctgcggagccgcgaccttgtcggccgagcgggtgaggggcgacaataaggagtacgagtactcggtcgaatgccaggaggactccgcctgccccgccgccgaggagtccctccccatcgaagtgatggtggacgccgtccacaagctgaagtacgagaactacaccagcagcttcttcatacgggatatcatcaagcccgaccccccgaagaacctgcagctgaaacccttgaagaactccaggcaggtggaggtgagctgggagtaccccgacacctggtccaccccgcactcatacttcagcctgaccttctgtgtacaggtccagggcaagagcaagagggaaaagaaggatagggtgttcaccgacaagacctccgccacggtgatctgtcggaaaaacgccagcatctccgtgcgggcccaggacaggtactattccagcagctggagcgagtgggcctccgtcccctgctccggcggcggtggcgggggcagcaggaacctccccgtggccacccccgatcccgggatgttcccatgcctgcaccacagccaaaacctgctgagggccgtctccaatatgctgcagaaggcgaggcagaccctggagttctacccctgtacctccgaggagatcgaccacgaggatatcaccaaggacaagacctccacggtcgaggcgtgcctgcccctggagctcacgaagaacgagagctgccttaactccagggaaacctcgtttatcacgaacggcagctgcctggcgtcacggaagacctcctttatgatggccctatgtctgtcctcgatctacgaggacctgaagatgtaccaggtggagttcaagaccatgaacgccaagctgctgatggatcccaagaggcagattttcctggaccagaacatgctggccgtgattgacgagctgatgcaggcgctgaacttcaacagcgagacagtgccgcagaagagctccctggaggagccggacttttacaagaccaagataaagctgtgcatcctgctccacgccttcagaatacgggccgtcaccatcgatagggtgatgtcttacctgaacgcctcctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 130 - DNA, 1829 bp, Artificial Sequence
  Synthetic: hIL12AB_030 (5UTR ORF  3UTR)
tcaagcttttggaccctcgtacagaagctaatacgactcactatagggaaataagagagaaaagaagagtaagaagaaatataagagccaccatgtgccaccagcagctggtgattagctggtttagcctggtgttcctggcaagccccctggtggccatctgggaactgaaaaaggacgtgtacgtggtcgagctggattggtaccccgacgcccccggcgaaatggtggtgctgacgtgtgatacccccgaggaggacgggatcacctggaccctggatcagagcagcgaggtgctggggagcgggaagaccctgacgatccaggtcaaggagttcggcgacgctgggcagtacacctgtcacaagggcggggaggtgctgtcccactccctgctgctcctgcataagaaagaggacggcatctggtccaccgacatcctcaaggaccagaaggagcccaagaacaagaccttcctgcggtgtgaggcgaagaactacagcggccgtttcacctgctggtggctgacgacaatcagcaccgacttgacgttctccgtgaagtcctccagaggcagctccgacccccaaggggtgacgtgcggcgcggccaccctgagcgccgagcgggtgcggggggacaacaaggagtacgagtactccgtggagtgccaggaggacagcgcctgtcccgcagccgaggagtccctgcccatcgaagtcatggtggacgccgtccacaagctgaagtacgagaactacaccagcagcttcttcatccgcgatatcatcaagcccgatccccccaaaaacctgcaactgaagccgctgaagaatagcaggcaggtggaggtgtcctgggagtacccggacacctggagcacgccccacagctatttcagcctgaccttttgcgtgcaggtccaggggaagagcaagcgggagaagaaggaccgcgtgtttacggacaaaaccagcgccaccgtgatctgcaggaagaacgccagcatcagcgtgagggcccaggacaggtactacagcagctcctggagcgagtgggcctccgtgccctgttccggaggcggcgggggcggttcccggaacctcccggtggccacccccgacccgggcatgttcccgtgcctgcaccactcacagaatctgctgagggccgtgagcaatatgctgcagaaggcaaggcagaccctggagttttatccctgcaccagcgaggagatcgaccacgaagacatcaccaaggacaagaccagcacagtggaggcctgcctgcccctggaactgaccaagaacgagtcctgtctgaactcccgggaaaccagcttcataaccaacggctcctgtctcgccagcaggaagaccagcttcatgatggccctgtgcctcagctccatctacgaggacctcaagatgtaccaggttgagttcaagaccatgaacgccaagctcctgatggaccccaagaggcagatcttcctggaccagaatatgctggccgtgatcgatgagttaatgcaggcgctgaacttcaacagcgagacggtgccccaaaagtcctcgctggaggagcccgacttctacaagaccaagatcaagctgtgcatcctcctgcacgccttccgaatccgggccgtaaccatcgacagggtgatgagctatctcaacgcctcctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 131 - DNA, 1829 bp, Artificial Sequence
  Synthetic: hIL12AB_031 (5UTR ORF  3UTR)
tcaagcttttggaccctcgtacagaagctaatacgactcactatagggaaataagagagaaaagaagagtaagaagaaatataagagccaccatgtgccaccagcagctcgtgatcagctggttctcgcttgtgttcctggcctcccccctcgtcgccatctgggagctgaagaaagacgtgtacgtggtggagctggactggtatcccgacgccccgggggagatggtggtgctgacctgcgacaccccggaagaggacggcatcacctggacgctcgaccagtcgtccgaagtgctggggtcgggcaagaccctcaccatccaggtgaaggagttcggagacgccggccagtacacctgtcataaggggggggaggtgctgagccacagcctcctgctcctgcacaaaaaggaggacggcatctggagcaccgatatcctcaaggaccagaaggagcccaagaacaagacgttcctgaggtgtgaggccaagaactacagcgggcggttcacgtgttggtggctcaccaccatctccaccgacctcaccttctccgtgaagtcaagcaggggcagctccgacccccaaggcgtcacctgcggcgccgccaccctgagcgccgagagggtcaggggggataacaaggaatacgagtacagtgtggagtgccaagaggatagcgcctgtcccgccgccgaagagagcctgcccatcgaagtgatggtggacgccgtgcacaagctgaagtacgagaactacacctccagcttcttcatcagggatatcatcaagcccgatccccccaagaacctgcagctgaagcccctgaagaacagcaggcaggtggaggtgagctgggagtatcccgacacgtggagcaccccgcacagctacttctcgctgaccttctgcgtgcaggtgcaagggaagtccaagagggagaagaaggatagggtgttcaccgacaaaacgagcgccaccgtgatctgccggaagaatgccagcatctctgtgagggcccaggacaggtactattccagctcctggtcggagtgggccagcgtgccctgtagcggcgggggcgggggcggcagcaggaacctcccggttgccacccccgaccccggcatgtttccgtgcctgcaccactcgcaaaacctgctgcgcgcggtctccaacatgctgcaaaaagcgcgccagacgctggagttctacccctgcaccagcgaggagatcgatcatgaagatatcaccaaagacaagacctcgaccgtggaggcctgcctgcccctggagctcaccaagaacgaaagctgcctgaacagcagggagacaagcttcatcaccaacggcagctgcctggcctcccggaagaccagcttcatgatggccctgtgcctgtccagcatctacgaggatctgaagatgtaccaagtggagtttaagaccatgaacgccaagctgttaatggaccccaaaaggcagatcttcctggatcagaacatgctggccgtcatcgacgagctgatgcaagccctgaacttcaacagcgagacggtgccccagaagagcagcctcgaggagcccgacttctataagaccaagataaagctgtgcattctgctgcacgccttcagaatcagggccgtgaccatcgatagggtgatgagctacctgaacgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 132 - DNA, 1829 bp, Artificial Sequence
  Synthetic: hIL12AB_032 (5UTR ORF  3UTR)
tcaagcttttggaccctcgtacagaagctaatacgactcactatagggaaataagagagaaaagaagagtaagaagaaatataagagccaccatgtgtcaccagcagctggtgatttcctggttcagtctggtgtttcttgccagccccctggtggccatctgggagctgaagaaagacgtatacgtcgtggagctggactggtatcccgacgctcccggcgagatggtggtcctcacctgcgacaccccagaggaggacggcatcacctggaccctggaccagagctccgaggtcctgggcagcggtaagaccctcaccatccaggtgaaggagtttggtgatgccgggcagtatacctgccacaagggcggcgaggtgctgtcccacagcctcctgttactgcataagaaggaggatggcatctggagcaccgacatcctcaaggaccagaaagagcccaagaacaagacctttctgcggtgcgaggcgaaaaattactccggccggttcacctgctggtggctgaccaccatcagcacggacctgacgttctccgtgaagtcgagcagggggagctccgatccccagggcgtgacctgcggcgcggccaccctgagcgccgagcgcgtccgcggggacaataaggaatacgaatatagcgtggagtgccaggaggacagcgcctgccccgcggccgaggagagcctcccgatcgaggtgatggtggatgccgtccacaagctcaaatacgaaaactacaccagcagcttcttcattagggacatcatcaagcccgacccccccaaaaacctgcagctgaagcccctgaagaacagccgccaggtcgaggtgtcatgggagtacccagacacctggagcaccccccactcctacttcagcctgaccttctgcgtccaggtgcagggaaagtccaaacgggagaagaaggatagggtctttaccgataagacgtcggccaccgtcatctgcaggaagaacgccagcataagcgtgcgggcgcaggatcggtactacagctcgagctggtccgaatgggcctccgtgccctgtagcggagggggtggcgggggcagcaggaacctgcccgtggccaccccggacccgggcatgtttccctgcctgcatcacagtcagaacctgctgagggccgtgagcaacatgctccagaaggcccgccagaccctggagttttacccctgcaccagcgaagagatcgatcacgaagacatcaccaaagacaagacctccaccgtggaggcctgtctgcccctggagctgaccaagaacgagagctgtctgaacagcagggagacctccttcatcaccaacggctcctgcctggcatcccggaagaccagcttcatgatggccctgtgtctgagctctatctacgaggacctgaagatgtaccaggtcgagttcaagaccatgaacgccaagctgctgatggaccccaagcgacagatattcctggaccagaacatgctcgccgtgatcgatgaactgatgcaagccctgaacttcaatagcgagaccgtgccccagaaaagcagcctggaggagcccgacttctacaagaccaagatcaaactgtgcatactgctgcacgcgttcaggatccgggccgtcaccatcgaccgggtgatgtcctatctgaatgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 133 - DNA, 1829 bp, Artificial Sequence
  Synthetic: hIL12AB_033 (5UTR ORF  3UTR)
tcaagcttttggaccctcgtacagaagctaatacgactcactatagggaaataagagagaaaagaagagtaagaagaaatataagagccaccatgtgccaccagcagctcgtgattagctggttttcgctggtgttcctggccagccctctcgtggccatctgggagctgaaaaaagacgtgtacgtggtggagctggactggtacccggacgcccccggcgagatggtggtgctgacgtgcgacaccccggaagaggacggcatcacctggaccctggaccagtcatccgaggtcctgggcagcggcaagacgctcaccatccaggtgaaggagttcggcgacgccggccagtacacatgccataagggcggggaggtgctgagccacagcctgctcctcctgcacaagaaggaggatggcatctggtctacagacatcctgaaggaccagaaagagcccaagaacaagaccttcctccggtgcgaggccaagaactactccgggcggtttacttgttggtggctgaccaccatcagcaccgacctcaccttcagcgtgaagagctcccgagggagctccgacccccagggggtcacctgcggcgccgccaccctgagcgccgagcgggtgaggggcgacaacaaggagtatgaatacagcgtggaatgccaagaggacagcgcctgtcccgcggccgaggaaagcctgcccatcgaggtgatggtggacgccgtccacaaactcaagtacgagaactacaccagcagtttcttcattcgcgacatcatcaagccggacccccccaaaaacctgcagctcaaacccctgaagaacagcaggcaggtggaggtcagctgggagtacccggacacctggagcaccccccatagctacttcagcctgaccttctgcgtgcaggtgcagggcaagagcaaacgcgagaagaaggaccgggtgtttaccgacaagaccagcgccacggtgatctgccgaaagaatgcaagcatctccgtgagggcgcaggaccgctactactctagcagctggagcgagtgggccagcgtgccctgcagcggtggcggcggaggcggcagccgtaacctccccgtggccacccccgaccccggcatgttcccgtgtctgcaccactcccagaacctgctgagggccgtcagcaatatgctgcagaaggcccggcagacgctggagttctacccctgcacctccgaggagatcgaccatgaggacattaccaaggacaagacgagcactgtggaggcctgcctgcccctggagctcaccaaaaacgagagctgcctgaatagcagggagacgtccttcatcaccaacggcagctgtctggccagcaggaagaccagcttcatgatggccctgtgcctctcctccatatatgaggatctgaagatgtaccaggtggagttcaagaccatgaacgccaagctgctgatggatcccaagaggcagatcttcctggaccagaatatgctggccgtgattgacgagctgatgcaggccctgaactttaatagcgagaccgtcccccagaagagcagcctggaggagcccgacttctataagaccaagatcaagctgtgcatactgctgcacgcgtttaggataagggccgtcaccatcgacagggtgatgagctacctgaatgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 134 - DNA, 1829 bp, Artificial Sequence
  Synthetic: hIL12AB_034 (5UTR ORF  3UTR)
tcaagcttttggaccctcgtacagaagctaatacgactcactatagggaaataagagagaaaagaagagtaagaagaaatataagagccaccatgtgccaccaacagctggtgatctcctggttcagcctggtgttcctcgccagccccctggtggccatctgggagctgaagaaagacgtgtacgtggtggagctggactggtatcccgacgcccccggcgagatggtcgtgctgacctgcgacaccccggaggaggacggcatcacctggaccctggatcagtcctccgaggtgctgggcagcgggaagaccctgaccatccaggtgaaagagttcggagatgccggccagtatacctgtcacaaggggggtgaggtgctgagccatagcctcttgcttctgcacaagaaggaggacggcatctggtccaccgacatcctcaaggaccaaaaggagccgaagaataaaacgttcctgaggtgcgaagccaagaactattccggacggttcacctgctggtggctgaccaccatcagcaccgacctcaccttctccgtaaagtcaagcaggggcagctccgacccccagggcgtgacctgcggagccgccaccctgagcgcagagagggtgaggggcgacaacaaggagtacgaatactccgtcgagtgccaggaggacagcgcctgccccgccgccgaggaaagtctgcccatcgaggtgatggtggacgccgtgcacaagctcaaatacgagaactacaccagcagcttcttcatccgggatatcatcaagcccgaccctccaaagaatctgcagctgaaaccccttaagaacagcaggcaggtggaggtcagctgggagtaccccgacacctggagcacgccccactcctactttagcctgaccttttgcgtgcaggtgcaggggaaaagcaagcgggagaagaaggacagggtgttcaccgataagacctccgctaccgtgatctgcaggaagaacgcctcaatcagcgtgagggcccaggatcggtactactccagctcctggagcgagtgggccagcgtgccctgctctggcggtggcggcgggggcagccggaacctgccggtggccactcccgacccgggcatgttcccgtgcctccaccattcccagaacctgctgcgggccgtgtccaatatgctccagaaggcaaggcagaccctggagttctacccctgcaccagcgaggagatcgatcacgaggacatcaccaaagacaaaaccagcacggtcgaggcctgcctgcccctggaactcaccaagaacgaaagctgtctcaacagccgcgagaccagcttcataaccaacggttcctgtctggcctcccgcaagaccagctttatgatggccctctgtctgagctccatctatgaagacctgaaaatgtaccaggtggagttcaaaaccatgaacgccaagcttctgatggaccccaagaggcagatcttcctggatcagaacatgctggccgtgatcgacgagctgatgcaggccctgaactttaactccgagaccgtgccccagaaaagcagcctggaagagcccgatttctacaaaacgaagatcaagctgtgcatcctgctgcacgccttccggatccgtgcggtgaccatcgatagggtgatgagctacctgaacgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 135 - DNA, 1829 bp, Artificial Sequence
  Synthetic: hIL12AB_035 (5UTR ORF  3UTR)
tcaagcttttggaccctcgtacagaagctaatacgactcactatagggaaataagagagaaaagaagagtaagaagaaatataagagccaccatgtgccaccaacagctggtaatcagctggttcagcctggttttcctcgcgtcgcccctggtggccatctgggagttaaagaaggacgtgtacgtggtggagctggattggtaccccgacgccccgggcgagatggtcgtgctcacctgcgatacccccgaggaggacgggatcacctggaccctggaccaatccagcgaggtgctgggcagcggcaagaccctgaccatacaggtgaaggaatttggggacgccgggcagtacacctgccacaagggcggggaagtgctgtcccactccctcctgctgctgcataagaaggaggacggcatctggagcaccgacatcctgaaggaccaaaaggagcccaagaacaagaccttcctgaggtgcgaggccaaaaactattccggccgctttacctgttggtggctgaccaccatctccaccgatctgaccttcagcgtgaagtcgtctaggggctcctccgacccccagggcgtaacctgcggcgccgcgaccctgagcgccgagagggtgcggggcgataacaaagagtacgagtactcggtggagtgccaggaggacagcgcctgtccggcggccgaggagagcctgcccatcgaggtgatggtggacgccgtccacaagctgaagtacgagaactacaccagttcgttcttcatcagggacatcatcaagccggacccccccaagaacctccagctgaagcccctgaagaacagcaggcaggtggaagtgtcctgggagtatcccgacacctggagcaccccccacagctacttcagcctgaccttttgcgtgcaggtgcagggcaaaagcaagagggaaaagaaggaccgggtgttcaccgataagacgagcgccaccgttatctgcaggaagaacgcctccataagcgtgagggcgcaggaccgttactacagcagcagctggagtgagtgggcaagcgtgccctgtagcggcgggggcgggggcgggtcccgcaacctccccgtcgccacccccgacccaggcatgtttccgtgcctgcaccacagccagaacctgctgcgggccgttagcaacatgctgcagaaggccaggcagaccctcgagttctatccctgcacatctgaggagatcgaccacgaagacatcactaaggataagacctccaccgtggaggcctgtctgcccctcgagctgaccaagaatgaatcctgcctgaacagccgagagaccagctttatcaccaacggctcctgcctggccagcaggaagacctccttcatgatggccctgtgcctctccagcatctacgaggatctgaagatgtaccaggtagagttcaagacgatgaacgccaagctcctgatggaccccaagaggcagatattcctggaccagaacatgctggcggtgatcgacgagctgatgcaggccctgaatttcaacagcgagacggtgccacagaagtccagcctggaggagccagacttctacaagaccaagatcaaactgtgcatcctcctgcacgcgttcaggatccgcgccgtcaccatagacagggtgatgagttatctgaacgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 136 - DNA, 1829 bp, Artificial Sequence
  Synthetic: hIL12AB_036 (5UTR ORF  3UTR)
tcaagcttttggaccctcgtacagaagctaatacgactcactatagggaaataagagagaaaagaagagtaagaagaaatataagagccaccatgtgccatcagcagctggtaatcagctggtttagcctggtgttcctggccagcccactggtggccatctgggagctgaagaaggacgtgtacgtggtggaactggactggtaccccgacgcccctggcgagatggtggtactgacctgtgacaccccggaggaagacggtatcacctggaccctggatcagagctccgaggtgctgggctccggcaagacactgaccatccaagttaaggaatttggggacgccggccagtacacctgccacaaggggggcgaggtgctgtcccactccctgctgcttctgcataagaaggaggatggcatctggtccaccgacatactgaaggaccagaaggagcccaagaataagaccttcctgagatgcgaggccaagaactactcgggaaggttcacctgctggtggctgaccaccatcagcaccgacctgaccttctccgtgaagagctcccggggcagctccgacccccagggcgtaacctgtggggccgctaccctgtccgccgagagggtccggggcgacaacaaggaatacgagtacagcgtggagtgccaggaggactccgcctgccccgccgccgaggagtcgctgcccatagaggtgatggtggacgccgtgcacaagctcaagtacgagaattacaccagcagcttctttatcagggacataattaagccggaccccccaaagaatctgcagctgaagcccctgaagaatagccggcaggtggaagtgtcctgggagtaccccgacacctggagcaccccccactcctatttctcactgacattctgcgtgcaggtgcaagggaaaagcaagagggagaagaaggatagggtgttcaccgacaagacaagcgccaccgtgatctgccgaaaaaatgccagcatcagcgtgagggcccaggatcggtattacagcagctcctggagcgagtgggccagcgtgccctgttccggcgggggagggggcggctcccggaacctgccggtggccacccccgaccctggcatgttcccctgcctgcatcacagccagaacctgctccgggccgtgtcgaacatgctgcagaaggcccggcagaccctcgagttttacccctgcaccagcgaagagatcgaccacgaagacataaccaaggacaagaccagcacggtggaggcctgcctgcccctggagcttaccaaaaacgagtcctgcctgaacagccgggaaaccagcttcataacgaacgggagctgcctggcctccaggaagaccagcttcatgatggcgctgtgtctgtccagcatatacgaggatctgaagatgtatcaggtggaattcaaaactatgaatgccaagctcctgatggaccccaagaggcagatcttcctggaccagaacatgctagccgtgatcgacgagctgatgcaggccctcaacttcaactcggagacggtgccccagaagtccagcctcgaggagcccgacttctacaagaccaagatcaagctgtgcatactgctgcatgccttcaggataagggcggtgactatcgacagggtcatgtcctacctgaacgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 137 - DNA, 1829 bp, Artificial Sequence
  Synthetic: hIL12AB_037 (5UTR ORF  3UTR)
tcaagcttttggaccctcgtacagaagctaatacgactcactatagggaaataagagagaaaagaagagtaagaagaaatataagagccaccatgtgccaccaacaactggtgatcagctggttctccctggtgttcctggccagccccctggtggccatctgggagctcaaaaaagacgtgtacgtggtggagctcgattggtacccagacgcgccgggggaaatggtggtgctgacctgcgacaccccagaggaggatggcatcacgtggacgctggatcagtccagcgaggtgctggggagcggcaagacgctcaccatccaggtgaaggaatttggcgacgcgggccagtatacctgtcacaagggcggcgaggtgctgagccactccctgctgctgctgcacaagaaggaggatgggatctggtcaaccgatatcctgaaagaccagaaggagcccaagaacaagaccttcctgcgctgcgaggccaagaactatagcggcaggttcacctgctggtggctgaccaccatcagcaccgacctgaccttcagcgtgaaatcctccaggggcagcagcgacccccagggcgtgacctgcggtgccgccacgctctccgccgagcgagtgaggggtgacaacaaggagtacgagtacagcgtggaatgtcaggaggacagcgcctgtcccgccgccgaggagtcgctgcccatcgaggtgatggtcgacgcggtgcacaagctcaaatacgagaattacaccagcagcttcttcatcagggacatcatcaagcccgacccccccaagaacctgcagctgaagcccttgaagaacagcaggcaggtggaggtgagctgggagtacccggacacctggagcaccccccactcctacttcagcctgacgttctgtgtgcaggtgcaggggaagtccaagagggagaagaaggaccgggtgttcaccgacaagaccagcgccaccgtgatatgccgcaagaacgcgtccatcagcgttcgcgcccaggaccgctactacagcagctcctggtccgaatgggccagcgtgccctgcagcggtggagggggcgggggctccaggaatctgccggtggccacccccgaccccgggatgttcccgtgtctgcatcactcccagaacctgctgcgggccgtgagcaatatgctgcagaaggccaggcagacgctcgagttctacccctgcacctccgaagagatcgaccatgaggacatcaccaaggacaagaccagcaccgtggaggcctgcctccccctggagctgaccaaaaacgagagctgcctgaactccagggagaccagctttataaccaacggcagctgcctcgcctccaggaagacctcgtttatgatggccctctgcctgtccagcatctacgaggacctgaagatgtaccaggtggagttcaagaccatgaacgcgaagttgctcatggaccccaagaggcagatcttcctggaccagaacatgctcgcggtgatcgacgagctgatgcaagccctgaacttcaacagcgagaccgtgccccagaagagcagcctggaagagcccgacttctacaagaccaagatcaagctgtgcatcctgctgcacgccttccggatccgggccgtgaccatcgacagggtgatgagctacctcaacgcctcctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 138 - DNA, 1829 bp, Artificial Sequence
  Synthetic: hIL12AB_038 (5UTR ORF  3UTR)
tcaagcttttggaccctcgtacagaagctaatacgactcactatagggaaataagagagaaaagaagagtaagaagaaatataagagccaccatgtgccaccagcagctcgtgatcagctggttctccctcgtcttcctggcctccccgctggtggccatctgggagctgaagaaggacgtgtacgtggtggagctggactggtatcccgacgcccccggcgagatggtggtgctgacgtgcgacacaccagaagaggacgggatcacatggaccctggatcagtcgtccgaggtgctggggagcggcaagaccctcaccatccaagtgaaggagttcggggacgccggccagtacacctgccacaagggcggggaggtgctctcccatagcctgctcctcctgcacaaaaaggaggatggcatctggagcaccgacatcctgaaggaccagaaggagcccaagaacaagacatttctcaggtgtgaggccaagaactattcgggcaggtttacctgttggtggctcaccaccatctctaccgacctgacgttctccgtcaagtcaagcagggggagctcggacccccagggggtgacatgtggggccgccaccctgagcgcggagcgtgtccgcggcgacaacaaggagtacgagtattccgtggagtgccaggaggacagcgcctgccccgccgccgaggagtccctgcccatagaggtgatggtggacgccgtccacaagttgaagtacgaaaattatacctcctcgttcttcattagggacatcatcaagcctgaccccccgaagaacctacaactcaagcccctcaagaactcccgccaggtggaggtgtcctgggagtaccccgacacctggtccaccccgcacagctacttcagcctgaccttctgcgtgcaggtccaggggaagagcaagcgtgaaaagaaagacagggtgttcaccgacaagacgagcgccaccgtgatctgcaggaaaaacgcctccatctccgtgcgcgcccaggacaggtactacagtagctcctggagcgaatgggccagcgtgccgtgcagcggcgggggaggaggcggcagtcgcaacctgcccgtggccacccccgaccccggcatgttcccatgcctgcaccacagccagaacctgctgagggcagtcagcaatatgctgcagaaggccaggcagaccctggagttttatccctgcaccagcgaggagatcgaccacgaggacatcaccaaggacaagacctccaccgtcgaggcctgcctgccactggagctgaccaaaaacgagagctgcctgaactccagggagacctccttcatcaccaacgggagctgcctggccagccggaagaccagcttcatgatggcgctgtgcctcagcagcatctacgaggatctcaagatgtaccaggtggagttcaagaccatgaacgcgaagctgctgatggaccccaagcggcagatcttcctggaccagaacatgctggccgtgattgacgagctcatgcaggccctgaacttcaatagcgagaccgtcccccaaaagagcagcctggaggaacccgacttctacaaaacgaagatcaagctctgcatcctgctgcacgccttccggatccgggccgtgaccatcgatcgtgtgatgagctacctgaacgcctcgtgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 139 - DNA, 1829 bp, Artificial Sequence
  Synthetic: hIL12AB_039 (5UTR ORF  3UTR)
tcaagcttttggaccctcgtacagaagctaatacgactcactatagggaaataagagagaaaagaagagtaagaagaaatataagagccaccatgtgccaccagcagctcgtcatctcctggtttagcctggtgtttctggcctcccccctggtcgccatctgggagctgaagaaagacgtgtacgtggtggagctggactggtacccggacgctcccggggagatggtggtgctgacctgcgacacccccgaggaggacggcatcacctggaccctggaccagagctccgaggtgctggggagcggcaagaccctgaccattcaggtgaaagagttcggcgacgccggccaatatacctgccacaaggggggggaggtcctgtcgcattccctgctgctgcttcacaaaaaggaggatggcatctggagcaccgacatcctgaaggaccagaaagaacccaagaacaagacgttcctgcgctgcgaggccaagaactacagcggccggttcacctgttggtggctgaccaccatctccaccgacctgactttctcggtgaagagcagccgcgggagcagcgacccccagggagtgacctgcggcgccgccaccctgagcgccgaaagggtgaggggcgacaataaagagtacgagtattccgtggagtgccaggaggacagcgcctgtcccgccgccgaggagtccctgcctatcgaggtgatggtcgacgcggtgcacaagctcaagtacgaaaactacaccagcagctttttcatcagggatatcatcaaaccagacccccccaagaacctgcagctgaagcccctgaaaaacagcaggcaggtggaagtgagctgggaataccccgatacctggtccaccccccacagctacttcagcctgaccttctgcgtgcaggtgcaggggaagtccaagcgggagaagaaagatcgggtgttcacggacaagaccagcgccaccgtgatttgcaggaaaaacgccagcatctccgtgagggctcaggacaggtactacagctccagctggagcgagtgggcctccgtgccttgcagcgggggaggaggcggcggcagcaggaatctgcccgtcgcaacccccgaccccggcatgttcccctgcctgcaccacagccagaatctgctgcgagccgtgagcaacatgctccagaaggcccggcagacgctggagttctacccctgcacctccgaggagatcgaccacgaggacatcaccaaggataagacgagcaccgtcgaggcctgtctccccctggagctcaccaagaacgagtcctgcctgaatagcagggagacgtccttcataaccaacggcagctgtctggcgtccaggaagaccagcttcatgatggccctctgcctgagctccatctacgaggacctcaagatgtaccaggtcgagttcaagaccatgaacgcaaaactgctcatggatccaaagaggcagatctttctggaccagaacatgctggccgtgatcgatgaactcatgcaggccctgaatttcaattccgagaccgtgccccagaagagctccctggaggaacccgacttctacaaaacaaagatcaagctgtgtatcctcctgcacgccttccggatcagggccgtcaccattgaccgggtgatgtcctacctgaacgccagctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 140 - DNA, 1829 bp, Artificial Sequence
  Synthetic: hIL12AB_040 (5UTR ORF  3UTR)
tcaagcttttggaccctcgtacagaagctaatacgactcactatagggaaataagagagaaaagaagagtaagaagaaatataagagccaccatgtgccatcagcagctggtgatcagctggttcagcctcgtgttcctcgccagccccctcgtggccatctgggagctgaaaaaggacgtgtacgtggtggagctggactggtatcccgacgccccgggcgagatggtggtgctgacctgcgacacccccgaggaggacggcattacctggacactggaccagagcagcgaggtcctgggcagcgggaagaccctgacaattcaggtgaaggagttcggcgacgccggacagtacacgtgccacaaggggggggaggtgctgtcccacagcctcctcctgctgcacaagaaggaggatggcatctggagcaccgacatcctgaaggatcagaaggagcccaagaacaagacctttctgagatgcgaggccaagaattacagcggccgtttcacctgctggtggctcaccaccatcagcaccgacctgaccttcagcgtgaaatcctccaggggctcctccgacccgcagggagtgacctgcggcgccgccacactgagcgccgagcgggtcagaggggacaacaaggagtacgagtacagcgttgagtgccaggaggacagcgcctgtcccgcggccgaggaatccctgcccatcgaggtgatggtggacgcagtgcacaagctgaagtacgagaactatacctcgagcttcttcatccgggatatcattaagcccgatcccccgaagaacctgcagctcaaacccctgaagaacagcaggcaggtggaggtctcctgggagtaccccgacacatggtccaccccccattcctatttctccctgaccttttgcgtgcaggtgcagggcaagagcaagagggagaaaaaggacagggtgttcaccgacaagacctccgccaccgtgatctgccgtaagaacgctagcatcagcgtcagggcccaggacaggtactatagcagctcctggtccgagtgggccagcgtcccgtgcagcggcgggggcggtggaggctcccggaacctccccgtggccaccccggaccccgggatgtttccctgcctgcatcacagccagaacctgctgagggccgtgtccaacatgctgcagaaggccaggcagacactcgagttttacccctgcaccagcgaggagatcgaccacgaagacatcaccaaggacaagacctccaccgtggaggcatgcctgcccctggagctgaccaaaaacgaaagctgtctgaactccagggagacctcctttatcacgaacggctcatgcctggcctccagaaagaccagcttcatgatggccctgtgcctgagctccatctacgaggacttgaaaatgtaccaggtcgagttcaagaccatgaacgccaagctgctcatggaccccaaaaggcagatctttctggaccagaatatgctggccgtgatcgacgagctcatgcaagccctgaatttcaacagcgagaccgtgccccagaagtcctccctggaggagcccgacttctacaagaccaagatcaagctgtgcatactcctgcacgcgtttaggatcagggcggtgaccatcgatagggtgatgagctacctgaatgcctcctgataataggctggagcctcggtggccatgcttcttgccccttgggcctccccccagcccctcctccccttcctgcacccgtaccccccaaacaccattgtcacactccagtggtctttgaataaagtctgagtgggcggc

SEQ ID NO: 141 - RNA, 1890 nt, Artificial Sequence
  Synthetic: hIL12AB_001 (mRNA with T100 tail)
  modified_base (1)..(1): g is a 5' terminal guanosine cap
ggggaaauaagagagaaaagaagaguaagaagaaauauaagagccaccaugugucaccagcagcuggucauuagcugguuuagccuuguguuccuggccuccccccuugucgcuauuugggagcucaagaaggacguguacgugguggaguuggauugguacccagacgcgcccggagagaugguaguucugaccugugauaccccagaggaggacggcaucaccuggacgcuggaccaaagcagcgagguuuugggcucagggaaaacgcugaccauccaggugaaggaauucggcgacgccgggcaguacaccugccauaagggaggagaggugcugagccauucccuucuucugcugcacaagaaagaggacggcaucuggucuaccgacauccugaaagaccagaaggagcccaagaacaaaaccuuccugaggugcgaggccaagaacuacuccggcagguucacuuguugguggcugaccaccaucaguacagaccugacuuuuaguguaaaaagcuccagaggcucguccgauccccaaggggugaccugcggcgcagccacucugagcgcugagcgcgugcgcggugacaauaaagaguacgaguacagcguugagugucaagaagauagcgcuugcccugccgccgaggagagccugccuaucgaggugaugguugacgcagugcacaagcuuaaguacgagaauuacaccagcucauucuucauuagagauauaaucaagccugacccacccaagaaccugcagcugaagccacugaaaaacucacggcaggucgaagugagcugggaguaccccgacaccuggagcacuccucauuccuauuucucucuuacauucugcguccaggugcagggcaagagcaagcgggaaaagaaggaucgagucuucaccgacaaaacaagcgcgaccgugauuugcaggaagaacgccagcaucuccgucagagcccaggauagauacuauaguagcagcuggagcgagugggcaagcgugcccuguuccggcggcgggggcgggggcagccgaaacuugccugucgcuaccccggacccuggaauguuuccgugucugcaccacagccagaaccugcugagagccgugucgaauaugcuccagaaggcccggcagacccuugaguucuaccccuguaccagcgaagagaucgaucaugaagauaucacgaaagauaaaacauccaccgucgaggcuugucucccgcuggagcugaccaagaacgagagcugucugaauagccgggagacgucuuucaucacgaaugguagcugucuggccagcaggaaaacuuccuucaugauggcucucugccugagcucuaucuaugaagaucugaagauguaucagguggaguuuaaaacaaugaacgccaaacuccugauggacccaaaaaggcaaaucuuucuggaccagaauaugcuggccgugauagacgagcugaugcaggcacugaacuucaacagcgagacggugccacagaaauccagccuggaggagccugacuuuuacaaaacuaagaucaagcuguguauccugcugcacgccuuuagaauccgugccgugacuaucgacagggugaugucauaccucaacgcuucaugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 142 - RNA, 1890 nt, Artificial Sequence
  Synthetic: hIL12AB_002 (mRNA with T100 tail)
  modified_base (1)..(1): g is a 5 terminal guanosine cap
ggggaaauaagagagaaaagaagaguaagaagaaauauaagagccaccaugugccaccagcagcuggugaucagcugguucagccugguguuccuggccagcccccugguggccaucugggagcugaagaaggacguguacgugguggaguuggauugguaccccgacgcccccggcgagaugguggugcugaccugcgacacccccgaggaggacggcaucaccuggacccuggaccagagcagcgaggugcugggcagcggcaagacccugaccauccaggugaaggaguucggcgacgccggccaguacaccugccacaagggcggcgaggugcugagccacagccugcugcugcugcacaagaaggaggacggcaucuggagcaccgacauccugaaggaccagaaggagcccaagaacaagaccuuccugagaugcgaggccaagaacuacagcggcagauucaccugcugguggcugaccaccaucagcaccgaccugaccuucagcgugaagagcagcagaggcagcagcgacccccagggcgugaccugcggcgccgccacccugagcgccgagagagugagaggcgacaacaaggaguacgaguacagcguggagugccaggaagauagcgccugccccgccgccgaggagagccugcccaucgaggugaugguggacgccgugcacaagcugaaguacgagaacuacaccagcagcuucuucaucagagauaucaucaagcccgacccccccaagaaccugcagcugaagccccugaagaacagccggcagguggaggugagcugggaguaccccgacaccuggagcaccccccacagcuacuucagccugaccuucugcgugcaggugcagggcaagagcaagagagagaagaaagauagaguguucaccgacaagaccagcgccaccgugaucugcagaaagaacgccagcaucagcgugagagcccaagauagauacuacagcagcagcuggagcgagugggccagcgugcccugcagcggcggcggcggcggcggcagcagaaaccugcccguggccacccccgaccccggcauguuccccugccugcaccacagccagaaccugcugagagccgugagcaacaugcugcagaaggcccggcagacccuggaguucuaccccugcaccagcgaggagaucgaccacgaagauaucaccaaagauaagaccagcaccguggaggccugccugccccuggagcugaccaagaacgagagcugccugaacagcagagagaccagcuucaucaccaacggcagcugccuggccagcagaaagaccagcuucaugauggcccugugccugagcagcaucuacgaggaccugaagauguaccagguggaguucaagaccaugaacgccaagcugcugauggaccccaagcggcagaucuuccuggaccagaacaugcuggccgugaucgacgagcugaugcaggcccugaacuucaacagcgagaccgugccccagaagagcagccuggaggagcccgacuucuacaagaccaagaucaagcugugcauccugcugcacgccuucagaaucagagccgugaccaucgacagagugaugagcuaccugaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 143 - RNA, 1890 nt, Artificial Sequence
  Synthetic: hIL12AB_003 (mRNA with T100 tail)
  modified_base (1)..(1): g is a 5 terminal guanosine cap
ggggaaauaagagagaaaagaagaguaagaagaaauauaagagccaccaugugucaccagcaguuggucaucucuugguuuucccugguuuuucuggcaucuccccucguggccaucugggaacugaagaaagacguuuacguuguagaauuggauugguauccggacgcuccuggagaaauggugguccucaccugugacaccccugaagaagacggaaucaccuggaccuuggaccagagcagugaggucuuaggcucuggcaaaacccugaccauccaagucaaagaguuuggagaugcuggccaguacaccugucacaaaggaggcgagguucuaagccauucgcuccugcugcuucacaaaaaggaagauggaauuugguccacugauauuuuaaaggaccagaaagaacccaaaaauaagaccuuucuaagaugcgaggccaagaauuauucuggacguuucaccugcugguggcugacgacaaucaguacugauuugacauucagugucaaaagcagcagaggcucuucugacccccaaggggugacgugcggagcugcuacacucucugcagagagagucagaggugacaacaaggaguaugaguacucaguggagugccaggaagauagugccugcccagcugcugaggagagucugcccauugaggucaugguggaugccguucacaagcucaaguaugaaaacuacaccagcagcuucuucaucagagauaucaucaaaccugacccacccaagaacuugcagcugaagccauuaaagaauucucggcagguggaggucagcugggaguacccugacaccuggaguacuccacauuccuacuucucccugacauucugcguucagguccagggcaagagcaagagagaaaagaaagauagagucuucacagauaagaccucagccacggucaucugccgcaaaaaugccagcauuagcgugcgggcccaggaccgcuacuauagcucaucuuggagcgaaugggcaucugugcccugcaguggcggagggggcggagggagcagaaaccuccccguggccacuccagacccaggaauguucccaugccuucaccacucccaaaaccugcugagggccgucagcaacaugcuccagaaggcccggcaaacuuuagaauuuuacccuugcacuucugaagagauugaucaugaagauaucacaaaagauaaaaccagcacaguggaggccuguuuaccauuggaauuaaccaagaaugagaguugccuaaauuccagagagaccucuuucauaacuaaugggaguugccuggccuccagaaagaccucuuuuaugauggcccugugccuuaguaguauuuaugaagauuugaagauguaccagguggaguucaagaccaugaaugcaaagcuucugauggauccuaagaggcagaucuuuuuagaucaaaacaugcuggcaguuauugaugagcugaugcaggcccugaauuucaacagugagacggugccacaaaaauccucccuugaagaaccagauuucuacaagaccaagaucaagcucugcauacuucuucaugcuuucagaauucgggcagugacuauugauagagugaugagcuaucugaaugcuuccugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 144 - RNA, 1893 nt, Artificial Sequence
  Synthetic: hIL12AB_004 (mRNA with T100 tail)
  modified_base (1)..(1): g is a 5 terminal guanosine cap
ggggaaauaagagagaaaagaagaguaagaagaaauauaagagccaccaugggcugccaccagcagcuggucaucagcugguucucccuggucuuccuggccagcccccugguggccaucugggagcugaagaaagacgucuacguaguagaguuggauugguacccagacgcaccuggagaaauggugguucucaccugugacacgccagaagaagacgguaucaccuggacgcuggaccagagcucagaaguucuuggcaguggaaaaacgcugaccauacaaguaaaagaauuuggggaugcuggccaguacaccugccacaaaggaggagaaguucucagccacagccugcugcugcugcacaagaaagaagauggcaucuggagcacagauauuuuaaaagaccagaaggagcccaagaacaaaaccuuccuucgaugugaggccaagaacuacaguggccgcuucaccugcugguggcucaccaccaucagcacagaccucaccuucucggugaagagcagccguggcagcucagacccccaaggagucaccuguggggcggccacgcugucggcagaaagaguucgaggugacaacaaggaauaugaauacucgguggaaugucaagaagauucggccugcccggcggcagaagaaagucuucccauagaagucaugguggaugcuguucacaaauuaaaauaugaaaacuacaccagcagcuucuucaucagagauaucaucaagccagacccgcccaagaaccugcagcugaagccccugaagaacagccggcagguggaaguuuccugggaguacccagauacguggagcacgccgcacagcuacuucagccucaccuucuguguacaaguacaaggcaagagcaagagagagaagaaagaucgugucuucacagauaaaaccucggcgacggucaucugcaggaagaaugccuccaucucgguucgagcccaggaccgcuacuacagcagcagcuggagugagugggccucggugcccugcagugguggcggcggcggcggcagcagaaaccuuccuguggccacgccggacccuggcauguucccgugccugcaccacagccaaaauuuacuucgagcuguuucuaacaugcugcagaaagcacggcaaacuuuagaauucuaccccugcaccucagaagaaauagaccaugaagauaucaccaaagauaaaaccagcacuguagaggccugccugccccuggagcucaccaagaaugaauccugccucaacagcagagagaccagcuucaucaccaauggcagcugccuggccagcaggaaaaccagcuucaugauggcgcucugccugagcagcaucuaugaagauuugaagauguaccaaguagaauuuaaaaccaugaaugccaagcugcucauggaccccaagcggcagauauuuuuggaucaaaacaugcuggcugucauugaugagcucaugcaagcauuaaacuucaacucagagacggugccccagaagagcagccuggaggagccagauuucuacaaaaccaagaucaagcucugcaucuuauuacaugccuuccgcauccgggcggucaccauugaccgugucauguccuacuuaaaugccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 145 - RNA, 1890 nt, Artificial Sequence
  Synthetic: hIL12AB_005 (mRNA with T100 tail)
  modified_base (1)..(1): g is a 5 terminal guanosine cap
ggggaaauaagagagaaaagaagaguaagaagaaauauaagagccaccaugugccaccagcagcuggucaucagcugguucucccuggucuuccuggccagcccccugguggccaucugggagcugaagaaagacgucuacguaguagaguuggauugguacccagacgcaccuggagaaauggugguucucaccugugacacgccagaagaagacgguaucaccuggacgcuggaccagagcucagaaguucuuggcaguggaaaaacgcugaccauacaaguaaaagaauuuggggaugcuggccaguacaccugccacaaaggaggagaaguucucagccacagccugcugcugcugcacaagaaagaagauggcaucuggagcacagauauuuuaaaagaccagaaggagcccaagaacaaaaccuuccuucgaugugaggccaagaacuacaguggccgcuucaccugcugguggcucaccaccaucagcacagaccucaccuucucggugaagagcagccguggcagcucagacccccaaggagucaccuguggggcggccacgcugucggcagaaagaguucgaggugacaacaaggaauaugaauacucgguggaaugucaagaagauucggccugcccggcggcagaagaaagucuucccauagaagucaugguggaugcuguucacaaauuaaaauaugaaaacuacaccagcagcuucuucaucagagauaucaucaagccagacccgcccaagaaccugcagcugaagccccugaagaacagccggcagguggaaguuuccugggaguacccagauacguggagcacgccgcacagcuacuucagccucaccuucuguguacaaguacaaggcaagagcaagagagagaagaaagaucgugucuucacagauaaaaccucggcgacggucaucugcaggaagaaugccuccaucucgguucgagcccaggaccgcuacuacagcagcagcuggagugagugggccucggugcccugcagugguggcggcggcggcggcagcagaaaccuuccuguggccacgccggacccuggcauguucccgugccugcaccacagccaaaauuuacuucgagcuguuucuaacaugcugcagaaagcacggcaaacuuuagaauucuaccccugcaccucagaagaaauagaccaugaagauaucaccaaagauaaaaccagcacuguagaggccugccugccccuggagcucaccaagaaugaauccugccucaacagcagagagaccagcuucaucaccaauggcagcugccuggccagcaggaaaaccagcuucaugauggcgcucugccugagcagcaucuaugaagauuugaagauguaccaaguagaauuuaaaaccaugaaugccaagcugcucauggaccccaagcggcagauauuuuuggaucaaaacaugcuggcugucauugaugagcucaugcaagcauuaaacuucaacucagagacggugccccagaagagcagccuggaggagccagauuucuacaaaaccaagaucaagcucugcaucuuauuacaugccuuccgcauccgggcggucaccauugaccgugucauguccuacuuaaaugccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 146 - RNA, 1890 nt, Artificial Sequence
  Synthetic: hIL12AB_006 (mRNA with T100 tail)
  modified_base (1)..(1): g is a 5 terminal guanosine cap
ggggaaauaagagagaaaagaagaguaagaagaaauauaagagccaccaugugccaccagcagcuggugaucagcugguucagccugguguuccuggccagcccccugguggccaucugggagcugaagaaggacguguacgugguggaguuggauugguaccccgacgcccccggcgagaugguggugcugaccugugacacccccgaggaggacggcaucaccuggacccuggaccagagcagcgaggugcugggcagcggcaagacccugaccauccaggugaaggaguucggggacgccggccaguacaccugccacaagggcggcgaggugcugagccacagccugcugcugcugcacaagaaggaggacggcaucuggagcacagauauccugaaggaccagaaggagcccaagaacaagaccuuccugagaugcgaggccaagaacuacagcggcagauucaccugcugguggcugaccaccaucagcacagauuugaccuucagcgugaagagcagcagaggcagcagcgacccccagggcgugaccugcggcgccgccacccugagcgccgagagagugagaggugacaacaaggaguacgaguacagcguggagugccaggaagauagcgccugccccgccgccgaggagagccugcccaucgaggugaugguggacgccgugcacaagcugaaguacgagaacuacaccagcagcuucuucaucagagauaucaucaagcccgacccgccgaagaaccugcagcugaagccccugaagaacagccggcagguggaggugagcugggaguaccccgacaccuggagcaccccccacagcuacuucagccugaccuucugcgugcaggugcagggcaagagcaagagagagaagaaagauagaguguucacagauaagaccagcgccaccgugaucugcagaaagaacgccagcaucagcgugagagcccaagauagauacuacagcagcagcuggagcgagugggccagcgugcccugcagcggcggcggcggcggcggcagcagaaaccugcccguggccacccccgaccccggcauguuccccugccugcaccacagccagaaccugcugagagccgugagcaacaugcugcagaaggcccggcagacccuggaguucuaccccugcaccagcgaggagaucgaccacgaagauaucaccaaagauaagaccagcaccguggaggccugccugccccuggagcugaccaagaaugaaagcugccugaacagcagagagaccagcuucaucaccaacggcagcugccuggccagcagaaagaccagcuucaugauggcccugugccugagcagcaucuacgaggaccugaagauguaccagguggaguucaagaccaugaacgccaagcugcugauggaccccaagcggcagaucuuccuggaccagaacaugcuggccgugaucgacgagcugaugcaggcccugaacuucaacagcgagaccgugccccagaagagcagccuggaggagcccgacuucuacaagaccaagaucaagcugugcauccugcugcacgccuucagaaucagagccgugaccaucgacagagugaugagcuaccugaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 147 - RNA, 1890 nt, Artificial Sequence
  Synthetic: hIL12AB_007 (mRNA with T100 tail)
  modified_base (1)..(1): g is a 5 terminal guanosine cap
ggggaaauaagagagaaaagaagaguaagaagaaauauaagagccaccaugugccaccagcagcuugucaucuccugguucucucuugucuuccuugcuucuccucuuguggccaucugggagcugaagaaggacguuuacguaguggaguuggauugguacccugacgcaccuggagaaauggugguucucaccugugacacuccugaggaggacgguaucaccuggacguuggaccagucuucugagguucuuggcaguggaaaaacucuuacuauucaggugaaggaguuuggagaugcuggccaguacaccugccacaaggguggugaaguucucagccacaguuuacuucuucuucacaagaaggaggauggcaucuggucuacugacauuuuaaaagaccagaaggagcccaagaacaaaacauuccuucguugugaagccaagaacuacaguggucguuucaccugcugguggcuuacuacuauuucuacugaccuuacuuucucugugaagucuucucguggcucuucugacccucagggugucaccuguggggcugcuacucuuucugcugagcgugugcguggugacaacaaggaguaugaauacucgguggagugccaggaagauucugccugcccugcugcugaggagucucuuccuauugaggugaugguggaugcugugcacaaguuaaaauaugaaaacuacacuucuucuuucuucauucgugacauuauaaaaccugacccucccaagaaccuucaguuaaaaccuuuaaaaaacucucgucagguggagguguccugggaguacccugacacguggucuacuccucacuccuacuucucucuuacuuucuguguccaggugcagggcaaguccaagcgugagaagaaggaccgugucuucacugacaaaacaucugcuacugucaucugcaggaagaaugcauccaucucugugcgugcucaggaccguuacuacagcucuuccuggucugagugggcuucugugcccugcucuggcggcggcggcggcggcagcagaaaucuuccuguggcuacuccugacccuggcauguuccccugccuucaccacucgcagaaccuucuucgugcugugagcaacaugcuucagaaggcucgucaaacuuuagaauucuaccccugcacuucugaggagauugaccaugaagauaucaccaaagauaaaacaucuacuguggaggccugccuuccuuuagagcugaccaagaaugaauccugcuuaaauucucgugagacgucuuucaucaccaauggcagcugccuugccucgcgcaaaacaucuuucaugauggcucuuugccuuucuuccaucuaugaagauuuaaaaauguaccagguggaguucaagaccaugaaugcaaagcuucucauggaccccaagcgucagauauuuuuggaccagaacaugcuugcugucauugaugagcucaugcaggcuuuaaacuucaacucugagacggugccucagaagucuucuuuagaagagccugacuucuacaagaccaagauaaaacuuugcauucuucuucaugcuuuccgcauccgugcugugacuauugaccgugugauguccuacuuaaaugcuucuugauaauaggcuggagccucgguggccaagcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 148 - RNA, 1890 nt, Artificial Sequence
  Synthetic: hIL12AB_008 (mRNA with T100 tail)
  modified_base (1)..(1): g is a 5 terminal guanosine cap
ggggaaauaagagagaaaagaagaguaagaagaaauauaagagccaccaugugucaucaacaacucgugauuagcugguucagucucguguuccuggccucuccgcugguggccaucugggagcuuaagaaggacguguacgugguggagcucgauugguaccccgacgcaccuggcgagaugguggugcuaaccugcgauacccccgaggaggacgggaucacuuggacccuggaucagaguagcgaaguccugggcucuggcaaaacacucacaauccaggugaaggaauucggagacgcuggucaguacacuugccacaaggggggugaagugcugucucacagccugcuguuacugcacaagaaggaggaugggaucuggucaaccgacauccugaaggaucagaaggagccuaagaacaagaccuuucugaggugugaagcuaagaacuauuccggaagauucacuugcuggugguugaccacaaucagcacugaccugaccuuuuccgugaaguccagcagaggaagcagcgauccucagggcguaacgugcggcgcggcuacccugucagcugagcggguuagaggcgacaacaaagaguaugaguacuccguggagugucaggaagauagcgccugccccgcagccgaggagagucugcccaucgaggugaugguggacgcuguccauaaguuaaaauacgaaaauuacacaaguuccuuuuucauccgcgauauuaucaaacccgauccccccaagaaccugcagcugaagccccugaagaauagccgacagguggaagucucuugggaguauccugacaccugguccacgccucacagcuacuuuagucugacuuucuguguccagguccagggcaagagcaagagagagaaaaaggauagaguguuuacugacaaaacaucugcuacagucaucugcagaaagaacgccaguaucucagugagggcgcaagauagauacuacaguaguagcuggagcgaaugggcuagcgugcccuguucagggggcggcggagggggcuccaggaaucugcccguggccacccccgacccugggauguucccuugccuccaucacucacagaaccugcucagagcagugagcaacaugcuccaaaaggcccgccagacccuggaguuuuacccuuguacuucagaagagaucgaucacgaagauauaacaaaggauaaaaccagcaccguggaggccugucugccucuggaacucacaaagaaugaaagcugucugaauuccagggaaaccuccuucauuacuaacggaagcugucucgcaucucgcaaaacaucauucaugauggcccucugccugucuucuaucuaugaagaucucaagauguaucagguggaguucaaaacaaugaacgccaagcugcugauggaccccaagcggcagaucuuccuggaccagaacaugcuggcagugaucgaugagcugaugcaagccuugaacuucaacucagagacggugccgcaaaaguccucguuggaggaaccagauuuuuacaaaaccaaaaucaagcuguguauccuucuucacgccuuucggaucagagccgugacuaucgaccgggugaugucauaccugaaugcuuccugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 149 - RNA, 1890 nt, Artificial Sequence
  Synthetic: hIL12AB_009 (mRNA with T100 tail)
  modified_base (1)..(1): g is a 5 terminal guanosine cap
ggggaaauaagagagaaaagaagaguaagaagaaauauaagagccaccaugugccaccagcagcuggucaucagcugguuuagccuggucuuccuggccagcccccugguggccaucugggagcugaagaaagacgucuacguaguagaguuggauugguacccagacgcaccuggagaaauggugguucucaccugcgacacgccagaagaagacgguaucaccuggacgcuggaccagagcagcgaaguacugggcaguggaaaaacgcugaccauacaaguaaaagaauuuggcgaugcuggccaguacaccugccacaaaggaggagaaguacugagccacagccugcugcugcugcacaagaaagaagauggcaucuggagcaccgacauuuuaaaagaccagaaggagcccaagaacaaaaccuuccuucgaugugaggcgaagaacuacaguggccgcuucaccugcugguggcucaccaccaucagcaccgaccucaccuucucggugaagagcagccgugguagcucagacccccaaggagucaccuguggggcggccacgcugucggcagaaagaguucgaggcgacaacaaggaauaugaauacucgguggaaugucaagaagauucggccugcccggcggcagaagaaagucugcccauagaagucaugguggaugcuguucacaaauuaaaauaugaaaacuacaccagcagcuucuucaucagagauaucaucaagccagacccccccaagaaccugcagcugaagccccugaagaacagccggcagguggaaguuuccugggaguacccagauacguggagcacgccgcacagcuacuucagccucaccuucuguguacaaguacaaggcaagagcaagagagagaagaaagaucgugucuucaccgacaaaaccucggcgacggucaucugcaggaagaaugcaagcaucucgguucgagcccaggaccgcuacuacagcagcagcuggagugagugggccucggugcccugcagugguggcggcggcggcggcagcagaaaccuuccuguggccacgccggacccuggcauguuuccgugccugcaccacagccaaaauuuauuacgagcuguuagcaacaugcugcagaaagcacggcaaacuuuagaauucuaccccugcaccucagaagaaauagaccaugaagauaucaccaaagauaaaaccagcacuguagaggccugccugccccuggagcucaccaagaacgagagcugccucaauagcagagagaccagcuucaucaccaauggcagcugccuggccagcaggaaaaccagcuucaugauggcgcucugccugagcagcaucuaugaagaucugaagauguaccaaguagaauuuaaaaccaugaaugccaagcugcucauggaccccaagcggcagauauuccucgaccaaaacaugcuggcugucauugaugagcucaugcaagcauuaaacuucaacucagagacggugccccagaagagcagccuggaggagccagauuucuacaaaaccaagaucaagcucugcaucuuauuacaugccuuccgcauccgggcggucaccauugaccgugucauguccuacuuaaaugccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 150 - RNA, 1890 nt, Artificial Sequence
  Synthetic: hIL12AB_010 (mRNA with T100 tail)
  modified_base (1)..(1): g is a 5 terminal guanosine cap
ggggaaauaagagagaaaagaagaguaagaagaaauauaagagccaccaugugccaccagcagcuugucaucuccugguuuucucuugucuuccucgcuucuccucuuguggccaucugggagcugaagaaagacgucuacguaguagaguuggauugguacccggacgcuccuggagaaauggugguucucaccugcgacacuccugaagaagacgguaucaccuggacgcuggaccaaagcagcgaaguuuuaggcucuggaaaaacgcugaccauacaaguaaaagaauuuggcgacgcuggccaguacacgugccacaaaggaggagaaguuuuaagccacaguuuacuucuucuucacaagaaagaagauggcaucuggaguacagauauuuuaaaagaccagaaggagccuaagaacaaaaccuuccuccgcugugaagcuaagaacuacaguggucguuucaccugcugguggcucaccaccaucuccacugaccucaccuucucuguaaaaucaagccgugguucuucugacccccaaggagucaccuguggggcugccacgcucagcgcugaaagaguucgaggcgacaacaaggaauaugaauauucuguggaaugucaagaagauucugccugcccggcggcagaagaaagucuucccauagaagucaugguggacgcuguucacaaauuaaaauaugaaaacuacaccagcagcuucuucauucgugacaucaucaaaccagacccuccuaagaaccuucaguuaaaaccgcugaagaacagccggcagguggaaguuuccugggaguacccagauacguggaguacgccgcacuccuacuucaguuuaaccuucuguguacaaguacaaggaaaaucaaaaagagagaagaaagaucgugucuucacugacaaaacaucugccacggucaucugccguaagaacgcuuccaucucgguucgagcccaggaccgcuacuacagcagcagcuggagugagugggcaucuguucccugcagugguggcggcggcggcggcagccgcaaccuuccuguggccacgccggacccuggcauguucccgugccuucaccacucgcaaaaucuucuucgugcuguuucuaacaugcugcagaaggcgcggcaaacuuuagaauucuacccgugcacuucugaagaaauagaccaugaagauaucaccaaagauaaaaccagcacgguggaggccugccuuccuuuagaacuuacuaagaacgaaaguugccuuaacagccgugagaccagcuucaucaccaauggcagcugccuugcuagcaggaagaccagcuucaugauggcgcugugccuuucuuccaucuaugaagaucuuaagauguaccaaguagaauuuaaaaccaugaaugccaaauuauuaauggaccccaagcggcagauauuccucgaccaaaacaugcuggcugucauugaugagcucaugcaagcauuaaacuucaacucagaaacuguuccccagaagucaucuuuagaagaaccagauuucuacaaaacaaaaauaaaacucugcauucuucuucaugccuuccgcauccgugcugucaccauugaccgugucauguccuacuuaaaugcuucuugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 151 - RNA, 1890 nt, Artificial Sequence
  Synthetic: hIL12AB_011 (mRNA with T100 tail)
  modified_base (1)..(1): g is a 5 terminal guanosine cap
ggggaaauaagagagaaaagaagaguaagaagaaauauaagagccaccaugugccaccagcagcuggugaucagcugguucagccugguguuccuggccagcccccugguggccaucugggagcugaagaaggacguguacgugguggaguuggauugguacccggacgcgccgggggagaugguggugcugacgugcgacacgccggaggaggacgggaucacguggacgcuggaccagagcagcgaggugcuggggagcgggaagacgcugacgauccaggugaaggaguucggggacgcggggcaguacacgugccacaaggggggggaggugcugagccacagccugcugcugcugcacaagaaggaggacgggaucuggagcacagauauccugaaggaccagaaggagccgaagaacaagacguuccugaggugcgaggcgaagaacuacagcgggagguucacgugcugguggcugacgacgaucagcacggaccugacguucagcgugaagagcagcagggggagcagcgacccgcagggggugacgugcggggcggcgacgcugagcgcggagagggugaggggugacaacaaggaguacgaguacagcguggagugccaggaagauagcgcgugcccggcggcggaggagagccugccgaucgaggugaugguggacgcggugcacaagcugaaguacgagaacuacacgagcagcuucuucaucagagauaucaucaagccggacccgccgaagaaccugcagcugaagccgcugaagaacagcaggcagguggaggugagcugggaguacccagauacguggagcacgccgcacagcuacuucagccugacguucugcgugcaggugcaggggaagagcaagagggagaagaaagauaggguguucacagauaagacgagcgcgacggugaucugcaggaagaacgcgagcaucagcgugagggcgcaagauagguacuacagcagcagcuggagcgagugggcgagcgugccgugcagcggggggggggggggggggagcaggaaccugccgguggcgacgccggacccggggauguucccgugccugcaccacagccagaaccugcugagggcggugagcaacaugcugcagaaggcgaggcagacgcuggaguucuacccgugcacgagcgaggagaucgaccacgaagauaucacgaaagauaagacgagcacgguggaggcgugccugccgcuggagcugacgaagaacgagagcugccugaacagcagggagacgagcuucaucacgaacgggagcugccuggcgagcaggaagacgagcuucaugauggcgcugugccugagcagcaucuacgaggaccugaagauguaccagguggaguucaagacgaugaacgcgaagcugcugauggacccgaagaggcagaucuuccuggaccagaacaugcuggcggugaucgacgagcugaugcaggcgcugaacuucaacagcgagacggugccgcagaagagcagccuggaggagccagauuucuacaagacgaagaucaagcugugcauccugcugcacgcguucaggaucagggcggugacgaucgacagggugaugagcuaccugaacgcgagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 152 - RNA, 1890 nt, Artificial Sequence
  Synthetic: hIL12AB_012 (mRNA with T100 tail)
  modified_base (1)..(1): g is a 5 terminal guanosine cap
ggggaaauaagagagaaaagaagaguaagaagaaauauaagagccaccaugugccaucagcagcuggugaucagcugguucagccucguguuucuggccagcccccugguggccauuugggaacucaagaaggacguguacguuguggaacucgacugguacccugacgccccaggcgaaaugguggucuuaaccugcgacaccccugaggaggacggaaucaccuggaccuuggaccagagcuccgagguccucggcaguggcaagacccugaccauacaggugaaagaauuuggagacgcagggcaauacacaugucacaagggcggggagguucuuucucacucccuucugcuucuacauaaaaaggaagacggaauuuggucuaccgacauccucaaggaccaaaaggagccuaagaauaaaaccuucuuacgcugugaagcuaaaaacuacagcggcagauucacuugcugguggcucaccaccauuucuaccgaccugaccuucucggugaagucuucaaggggcucuagugauccacagggagugacaugcggggccgccacacugagcgcugaacgggugaggggcgauaacaaggaguaugaauacucugucgagugucaggaggauucagcuugucccgcagcugaagagucacuccccauagagguuauggucgaugcugugcauaaacugaaguacgaaaacuacaccagcagcuucuucauuagagauauuauaaaaccugacccccccaagaaccugcaacuuaaaccccugaaaaacucucggcaggucgaaguuagcugggaguacccugauacuugguccaccccccacucguacuucucacugacuuucugugugcaggugcagggcaagagcaagagagagaaaaaagaucguguauucacagauaagaccucugccaccgugaucugcagaaaaaacgcuuccaucagugucagagcccaagaccgguacuauaguaguagcuggagcgagugggcaaguguccccugcucuggcggcggagggggcggcucucgaaaccuccccgucgcuaccccugauccaggaauguucccuugccugcaucacucacagaaucugcugagagcggucagcaacaugcugcagaaagcuaggcaaacacuggaguuuuauccuuguaccucagaggagaucgaccacgaggauauuaccaaagauaagaccagcacgguggaggccugcuugccccuggaacugacaaagaaugaauccugccuuaauagccgugagaccucuuuuauaacaaacggauccugccuggccagcaggaagaccuccuucaugauggcccucugccuguccucaaucuacgaagaccugaagauguaccagguggaauuuaaaacuaugaacgccaagcuguugauggaccccaagcggcagaucuuucuggaucaaaauaugcuggcugugaucgacgaacugaugcaggcccucaacuuuaacagcgagaccgugccacaaaagagcagucuugaggagcccgacuucuacaagaccaagaucaagcugugcauccuccuucaugccuucaggauaagagcugucaccaucgacagagucaugaguuaccugaaugcauccugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 153 - RNA, 1890 nt, Artificial Sequence
  Synthetic: hIL12AB_013 (mRNA with T100 tail)
  modified_base (1)..(1): g is a 5 terminal guanosine cap
ggggaaauaagagagaaaagaagaguaagaagaaauauaagagccaccaugugccaccagcagcuggucaucuccugguucagucuugucuuccuggccucgccgcugguggccaucugggagcugaagaaagacguuuacguaguagaguuggauugguacccagacgcaccuggagaaauggugguccucaccugugacacgccagaagaagacgguaucaccuggacgcuggaccagagcagugaaguucuuggaaguggaaaaacgcugaccauacaaguaaaagaauuuggagaugcuggccaguacaccugccacaaaggaggagaaguucucagccacaguuuauuauuacuucacaagaaagaagauggcaucugguccacagauauuuuaaaagaccagaaggagcccaaaaauaaaacauuucuucgaugugaggccaagaacuacaguggucguuucaccugcugguggcugaccaccaucuccacagaccucaccuucaguguaaaaagcagccgugguucuucugacccccaaggagucaccuguggggcugccacgcucucugcagaaagaguucgaggugacaacaaagaauaugaguacucgguggaaugucaagaagauucggccugcccagcugcugaggagagucuucccauagaagucaugguggaugcuguucacaaauuaaaauaugaaaacuacaccagcagcuucuucaucagagauaucaucaaaccugacccgcccaagaacuuacagcugaagccgcugaaaaacagccggcagguagaaguuuccugggaguacccagauaccugguccacgccgcacuccuacuucucccucaccuucuguguacaaguacaaggcaagagcaagagagagaagaaagaucgugucuucacagauaaaacaucagccacggucaucugcaggaaaaaugccagcaucucggugcgggcccaggaccgcuacuacagcagcagcuggagugagugggcaucugugcccugcagugguggugggggugguggcagcagaaaccuuccuguggccacuccagacccuggcauguucccgugccuucaccacucccaaaauuuacuucgagcuguuucuaacaugcugcagaaagcacggcaaacuuuagaauucuacccgugcacuucugaagaaauugaccaugaagauaucacaaaagauaaaaccagcacaguggaggccugucuuccuuuagagcugaccaaaaaugaauccugccucaacagcagagagaccagcuucaucaccaauggcagcugccuggccuccaggaaaaccagcuucaugauggcgcucugccucagcuccaucuaugaagauuugaagauguaccaaguagaauuuaaaaccaugaaugccaaauuauuaauggaccccaagaggcagauauuuuuagaucaaaacaugcuggcaguuauugaugagcucaugcaagcauuaaacuucaacagugagacgguaccucaaaaaagcagccuugaagagccagauuucuacaaaaccaagaucaaacucugcauuuuacuucaugccuuccgcauccgggcggucaccauugaccgugucauguccuacuuaaaugccucgugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 154 - RNA, 1890 nt, Artificial Sequence
  Synthetic: hIL12AB_014 (mRNA with T100 tail)
  modified_base (1)..(1): g is a 5 terminal guanosine cap
ggggaaauaagagagaaaagaagaguaagaagaaauauaagagccaccaugugccaccagcagcuugugauuucuugguucucucuuguguuccuugcuucuccucuuguggcuauuugggaguuaaaaaaggacguguacgugguggagcuugacugguacccugacgcaccuggcgagaugguggugcuuacuugugacacuccugaggaggacggcauuacuuggacgcuugaccagucuucugaggugcuuggcucuggcaaaacacuuacuauucaggugaaggaguucggggaugcuggccaguacacuugccacaagggcggcgaggugcuuucucacucucuucuucuucuucacaagaaggaggacggcauuuggucuacugacauuuuaaaagaccagaaggagcccaagaacaaaacauuccuucguugcgaggccaagaacuacucuggccguuucacuugcugguggcuuacuacuauuucuacugaccuuacuuucucugugaagucuucucguggcucuucugacccucagggcgugacuuguggggcugcuacucuuucugcugagcgugugcguggugacaacaaggaguacgaguacucuguggagugccaggaagauucugcuugcccugcugcugaggagucucuuccuauugaggugaugguggaugcugugcacaaguuaaaauacgagaacuacacuucuucuuucuucauucgugacauuauuaagccugacccucccaagaaccuucaguuaaaaccuuuaaaaaacucucgucagguggaggugucuugggaguacccugacacuuggucuacuccucacucuuacuucucucuuacuuucugcgugcaggugcagggcaagucuaagcgugagaagaaggaccguguguucacugacaaaacaucugcuacugugauuugcaggaagaaugcaucuauuucugugcgugcucaggaccguuacuacucuucuucuuggucugagugggcuucugugccuugcucuggcggcggcggcggcggcuccagaaaucuuccuguggcuacuccugacccuggcauguucccuugccuucaccacucucagaaccuucuucgugcugugagcaacaugcuucagaaggcucgucaaacucuugaguucuacccuugcacuucugaggagauugaccacgaagauaucaccaaagauaaaacaucuacuguggaggcuugccuuccucuugagcuuaccaagaaugaaucuugcuuaaauucucgugagacgucuuucaucaccaacggcucuugccuugccucgcgcaaaacaucuuucaugauggcucuuugccuuucuucuauuuacgaagauuuaaaaauguaccagguggaguucaaaacaaugaaugcaaagcuucuuauggaccccaagcgucagauuuuccuugaccagaacaugcuugcugugauugacgagcuuaugcaggcuuuaaauuucaacucugagacggugccucagaagucuucucuugaggagccugacuucuacaagaccaagauuaagcuuugcauucuucuucaugcuuuccguauucgugcugugacuauugaccgugugaugucuuacuuaaaugcuucuugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 155 - RNA, 1890 nt, Artificial Sequence
  Synthetic: hIL12AB_015 (mRNA with T100 tail)
  modified_base (1)..(1): g is a 5 terminal guanosine cap
ggggaaauaagagagaaaagaagaguaagaagaaauauaagagccaccaugugucaccagcagcuggugaucagcugguuuagccugguguuucuggccagcccccugguggccaucugggaacugaagaaagacguguacgugguagaacuggauugguauccggacgcucccggcgaaaugguggugcugaccugugacacccccgaagaagacggaaucaccuggacccuggaccagagcagcgaggugcugggcagcggcaaaacccugaccauccaagugaaagaguuuggcgaugccggccaguacaccugucacaaaggcggcgaggugcuaagccauucgcugcugcugcugcacaaaaaggaagauggcaucuggagcaccgauauccugaaggaccagaaagaacccaaaaauaagaccuuucuaagaugcgaggccaagaauuauagcggccguuucaccugcugguggcugacgaccaucagcaccgaucugaccuucagcgugaaaagcagcagaggcagcagcgacccccaaggcgugacgugcggcgccgccacccugagcgccgagagagugagaggcgacaacaaggaguaugaguacagcguggagugccaggaagauagcgccugccccgccgccgaggagagccugcccaucgaggugaugguggaugccgugcacaagcugaaguaugaaaacuacaccagcagcuucuucaucagagauaucaucaaacccgacccccccaagaaccugcagcugaagccccugaagaauagccggcagguggaggugagcugggaguaccccgacaccuggagcaccccccauagcuacuucagccugaccuucugcgugcaggugcagggcaagagcaagagagaaaagaaagauagaguguucacagauaagaccagcgccacggugaucugcagaaaaaaugccagcaucagcgugagagcccaagauagauacuauagcagcagcuggagcgaaugggccagcgugcccugcagcggcggcggcggcggcggcagcagaaaccugcccguggccacccccgaccccggcauguuccccugccugcaccacagccaaaaccugcugagagccgugagcaacaugcugcagaaggcccggcagacccuggaauuuuaccccugcaccagcgaagagaucgaucaugaagauaucaccaaagauaaaaccagcaccguggaggccugucugccccuggaacugaccaagaaugagagcugccuaaauagcagagagaccagcuucauaaccaauggcagcugccuggccagcagaaagaccagcuuuaugauggcccugugccugagcagcaucuaugaagaccugaagauguaccagguggaguucaagaccaugaaugccaagcugcugauggaucccaagcggcagaucuuucuggaucaaaacaugcuggccgugaucgaugagcugaugcaggcccugaauuucaacagcgagaccgugccccaaaaaagcagccuggaagaaccggauuuuuauaaaaccaaaaucaagcugugcauacugcugcaugccuucagaaucagagccgugaccaucgauagagugaugagcuaucugaaugccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 156 - RNA, 1890 nt, Artificial Sequence
  Synthetic: hIL12AB_016 (mRNA with T100 tail)
  modified_base (1)..(1): g is a 5 terminal guanosine cap
ggggaaauaagagagaaaagaagaguaagaagaaauauaagagccaccaugugccaccagcagcuggucaucagcugguucagccuggucuuccuggccagcccccugguggccaucugggagcugaagaaggacguauacguaguggaguuggauugguacccagacgcuccuggggagaugguggugcugaccugugacaccccagaagaggacgguaucaccuggacccuggaccagagcucagaagugcugggcaguggaaaaacccugaccauccaggugaaggaguuuggagaugcuggccaguacaccugccacaaggguggugaagugcugagccacagccugcugcugcugcacaagaaggaggauggcaucuggagcacagauauccugaaggaccagaaggagcccaagaacaagaccuuccuucgcugugaagccaagaacuacaguggccgcuucaccugcugguggcugaccaccaucagcacagaccucaccuucucggugaagagcagcagaggcagcucagacccccagggugucaccuguggggcggccacgcugucggcggagagaguucgaggugacaacaaggaguaugaauacucgguggagugccaggaagauucggcgugcccggcggcagaagagagccugcccauagaagugaugguggaugcugugcacaagcugaaguaugaaaacuacaccagcagcuucuucaucagagauaucaucaagccagacccgcccaagaaccugcagcugaagccccugaagaacagccggcagguggagguuuccugggaguacccagauacguggagcaccccccacagcuacuucagccugaccuucuguguccaggugcagggcaagagcaagagagagaagaaagauagagucuucacagauaagaccucggccacggucaucugcagaaagaaugccuccaucucgguucgagcccaagauagauacuacagcagcagcuggucagaaugggccucggugcccugcagugguggcggcggcggcggcagcagaaaccugccuguugccaccccagacccugggauguuccccugccugcaccacagccagaacuuauuacgagcuguuucuaacaugcugcagaaggcccggcagacccuggaguucuaccccugcaccucagaagagauugaccaugaagauaucaccaaagauaagaccagcacuguagaggccugccugccccuggagcugaccaagaaugaaagcugccugaacagcagagagaccagcuucaucaccaauggaagcugccuggccagcagaaagaccagcuucaugauggcccugugccugagcagcaucuaugaagaccugaagauguaccagguggaguucaagaccaugaaugcaaagcugcugauggaccccaagcggcagauauuuuuggaccagaacaugcuggcugucauugaugagcugaugcaggcccugaacuucaacucagaaacuguaccccagaagagcagccuggaggagccagauuucuacaagaccaagaucaagcugugcauccugcuucaugcuuucagaaucagagcugucaccauugaccgcgugaugagcuacuuaaaugccucgugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 157 - RNA, 1890 nt, Artificial Sequence
  Synthetic: hIL12AB_017 (mRNA with T100 tail)
  modified_base (1)..(1): g is a 5 terminal guanosine cap
ggggaaauaagagagaaaagaagaguaagaagaaauauaagagccaccaugugccaccagcagcugguaaucagcugguuuucccucgucuuucuggcaucaccccugguggcuaucugggagcugaagaaggacguguacgugguggagcuggauugguacccugacgccccgggggaaauggugguguuaaccugcgacacgccugaggaggacggcaucaccuggacgcuggaccagagcagcgaggugcuugggucugguaaaacucugacuauucaggugaaagaguucggggaugccggccaauauacuugccacaaggguggcgaggugcuuucucauucucugcuccugcugcacaagaaagaagauggcauuuggucuacugauauucugaaagaccagaaggagcccaagaacaagaccuuucugagaugcgaggcuaaaaacuacagcggaagauuuaccugcugguggcugaccacaaucucaaccgaccugacauuuucagugaaguccagcagagggagcuccgacccucagggcgugaccugcggagccgccacucuguccgcagaaagagugagaggugauaauaaggaguacgaguauucagucgagugccaagaagauucugccugcccagccgccgaggagagccugccaaucgaggugaugguagaugcgguacacaagcugaaguaugagaacuacacauccuccuucuucauaagagauauuaucaagccugacccaccuaaaaaucugcaacucaagccuuugaaaaauucacggcagguggaggugagcugggaguacccugauacuuggagcaccccccauagcuacuuuucgcugacauucugcguccaggugcagggcaagucaaagagagagaagaaggaucgcguguucacugauaaaacaagcgccacagugaucugcagaaaaaacgcuagcauuagcgucagagcacaggaccgguauuacuccagcuccuggagcgaaugggcaucugugcccugcagcggugggggcggaggcggauccagaaaccuccccguugccacaccugauccuggaauguuccccugucugcaccacagccagaaccugcugagagcagugucuaacaugcuccagaaggccaggcagacccuggaguuuuaccccugcaccagcgaggaaaucgaucacgaagauaucaccaaagauaaaaccuccaccguggaggccugccugccccuggaacugaccaaaaacgagagcugccugaauagcagggagaccuccuucaucaccaacggcucaugccuugccagccggaaaacuagcuucaugauggcccugugccugucuucgaucuaugaggaccugaaaauguaccaggucgaauuuaagacgaugaacgcaaagcugcugauggaccccaagcggcagaucuuucuggaccagaacaugcuggcagucauagaugaguugaugcaggcauuaaacuucaacagcgagaccgugccucagaaguccagccucgaggagccagauuuuuauaagaccaagaucaaacuaugcauccugcugcaugcuuucaggauuagagccgucaccaucgaucgagucaugucuuaccugaaugcuagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 158 - RNA, 1890 nt, Artificial Sequence
  Synthetic: hIL12AB_018 (mRNA with T100 tail)
  modified_base (1)..(1): g is a 5 terminal guanosine cap
ggggaaauaagagagaaaagaagaguaagaagaaauauaagagccaccaugugucaccaacaguuaguaaucuccugguuuucucugguguuucuggccagcccccucguggccaucugggagcuuaaaaaggacguuuacgugguggaguuggauugguaucccgacgcuccaggcgaaauggucgugcugaccugcgauaccccugaagaagacgguaucaccuggacgcuggaccagucuuccgaggugcuuggaucuggcaaaacacugacaauacaaguuaaggaguucggggacgcagggcaguacaccugccacaaaggcggcgagguccugagucacucccuguuacugcuccacaagaaagaggacggcauuugguccaccgacauucugaaggaccagaaggagccuaagaauaaaacuuuccugagaugcgaggcaaaaaacuauagcggccgcuuuacuugcugguggcuuacaacaaucucuaccgauuuaacuuucuccgugaagucuagcagaggauccucugacccgcaaggagugacuugcggagccgccaccuugagcgccgaaagaguccguggcgauaacaaagaauacgaguacuccguggagugccaggaagauuccgccugcccagcugccgaggagucccugcccauugaagugaugguggaugccguccacaagcugaaguacgaaaacuauaccagcagcuucuucauccgggauaucauuaagcccgacccuccuaaaaaccugcaacuuaagccccuaaagaauagucggcagguugaggucagcugggaauauccugacacauggagcaccccccacucuuauuucucccugaccuucugcgugcaggugcagggcaagaguaaacgggagaaaaaagauagggucuuuaccgauaaaaccagcgcuacgguuaucugucggaagaacgcuuccaucuccguccgcgcucaggaucguuacuacucguccucauggagcgagugggccagcgugcccugcagcggcggcgguggaggcggauccagaaaucugccuguugccacaccagacccuggcauguuccccugucugcaucauagccagaaccugcucagagccgugagcaacaugcuccagaaggccaggcaaacuuuggaguucuacccguguacaucugaggaaaucgaucacgaagauauaaccaaagauaaaaccucuacaguagaggcuuguuugccccuggaguugaccaaaaacgagaguugccugaacagucgcgagacgagcuucauuacuaacggcagcugucucgccuccagaaaaacauccuucaugauggcccugugucuuuccagcauauacgaagaccugaaaauguaccaggucgaguucaaaacaaugaacgccaagcugcuuauggaccccaagcggcagaucuuccucgaccaaaacaugcucgcugugaucgaugagcugaugcaggcucucaacuucaauuccgaaacagugccacagaaguccagucuggaagaacccgacuucuacaagaccaagauuaagcuguguauuuugcugcaugcguuuagaaucagagccgugaccauugaucgggugaugagcuaccugaacgccucgugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 159 - RNA, 1890 nt, Artificial Sequence
  Synthetic: hIL12AB_019 (mRNA with T100 tail)
  modified_base (1)..(1): g is a 5 terminal guanosine cap
ggggaaauaagagagaaaagaagaguaagaagaaauauaagagccaccaugugccaccagcagcuugucaucuccugguuuucucuugucuuccuggccucgccgcugguggccaucugggagcugaagaaagacguuuacguaguagaguuggauugguacccagacgcaccuggagaaauggugguucucaccugugacacuccugaagaagacgguaucaccuggacgcuggaccaaagcucagaaguucuuggcaguggaaaaacgcugaccauacaaguaaaagaauuuggggaugcuggccaguacacgugccacaaaggaggagaaguucucagccacaguuuacuucuucuucacaagaaagaagauggcaucugguccacagauauuuuaaaagaccagaaggagcccaagaacaaaaccuuccuccgcugugaggccaagaacuacaguggucguuucaccugcugguggcucaccaccaucuccacugaccucaccuucucuguaaaaagcagccgugguucuucugacccccaaggagucaccuguggggcugccacgcucucggcagaaagaguucgaggugacaacaaggaauaugaauauucuguggaaugucaagaagauucugccugcccggcggcagaagaaagucuucccauagaagucaugguggaugcuguucacaaauuaaaauaugaaaacuacaccagcagcuucuucauucgugacaucaucaaaccagacccgcccaagaaccuucaguuaaaaccuuuaaaaaacagccggcagguagaaguuuccugggaguacccagauacgugguccacgccgcacuccuacuucaguuuaaccuucuguguacaaguacaaggaaaaucaaaaagagagaagaaagaucgugucuucacugacaaaacaucugccacggucaucugcaggaagaaugccuccaucucgguucgagcccaggaccgcuacuacagcagcagcuggagugagugggcaucuguucccugcagugguggcggcggcggcggcagccgcaaccuuccuguggccacgccggacccuggcauguucccgugccuucaccacucccaaaaucuucuucgugcuguuucuaacaugcugcagaaggcgcgccaaacuuuagaauucuacccgugcacuucugaagaaauagaccaugaagauaucaccaaagauaaaaccagcacgguggaggccugccuuccuuuagagcugaccaagaaugaauccugccucaacagcagagagaccagcuucaucaccaauggcagcugccuggccucgcgcaagaccagcuucaugauggcgcugugccuuucuuccaucuaugaagauuuaaagauguaccaaguagaauuuaaaaccaugaaugccaaauuauuaauggaccccaaacggcagauauuuuuggaucaaaacaugcuggcugucauugaugagcucaugcaagcauuaaacuucaacucagaaacuguuccccagaagucaucuuuagaagagccagauuucuacaaaacaaaaauaaaacucugcauucuucuucaugccuuccgcauccgugcugucaccauugaccgugucauguccuacuuaaaugcuucuugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 160 - RNA, 1890 nt, Artificial Sequence
  Synthetic: hIL12AB_020 (mRNA with T100 tail)
  modified_base (1)..(1): g is a 5 terminal guanosine cap
ggggaaauaagagagaaaagaagaguaagaagaaauauaagagccaccaugugccaccagcagcuggugaucagcugguucagccugguguuccuggcuagcccucugguggccaucugggagcugaagaaggacguguacgugguggaguuggauugguaccccgacgcucccggcgagaugguggugcugaccugcgacacccccgaggaggacgggaucaccuggacccuggaucagucaagcgaggugcugggaagcggcaagacccugaccauccaggugaaggaguucggcgacgccggccaauacacuugccacaagggaggcgaggugcugucccacucccuccugcugcugcacaaaaaggaagacggcaucuggagcaccgacauccugaaagaccagaaggagccuaagaacaaaacauuccucagaugcgaggccaagaauuacuccgggagauucaccuguugguggcugaccaccaucagcacagaccugaccuucagcgugaagagcagcagaggcagcagcgacccccagggcgugaccuguggcgccgccacccugagcgccgaaagagugcgcggcgacaacaaggaguacgaguacuccguggaaugccaggaagauagcgccugccccgccgccgaggagagccugcccaucgaggugaugguggacgccguccacaagcugaaguacgagaacuacaccucuagcuucuucaucagagauaucaucaagcccgauccccccaagaaccugcagcugaaaccccugaagaacagccggcagguggaggugagcugggaguaucccgacaccugguccaccccccacagcuauuuuagccugaccuucugcgugcaagugcagggcaagagcaagagagagaagaaggaccgcguguucaccgacaaaaccagcgccaccgugaucugcagaaagaacgccagcaucagcgugagggcccaggauagauacuacaguuccagcuggagcgagugggccagcgugcccugcagcggcggcggcgggggaggcucgagaaaccugcccguggcuacccccgaucccggaauguuccccugccugcaccacagccagaaccugcugagggcgguguccaacaugcuucagaaggcccggcagacccuggaguucuaccccuguaccucugaggagaucgaucaugaagauaucacaaaagauaaaaccagcaccguggaggccugccugccccuggagcugaccaagaacgagagcugccugaacucccgcgagaccagcuucaucacgaacggcagcugccuggccagcaggaagaccuccuucaugauggcccugugccugagcagcaucuacgaggaccugaaaauguaccagguggaguuuaagaccaugaacgccaagcugcugauggaccccaagcggcaaaucuuccuggaccagaacaugcuggcagugaucgacgagcucaugcaggcccugaacuucaauagcgagacggucccccagaagagcagccuggaggagcccgacuuuuacaagaccaagaucaagcugugcauccugcugcacgccuuuagaauccgugccgugaccauugacagagugaugagcuaccugaaugccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 161 - RNA, 1890 nt, Artificial Sequence
  Synthetic: hIL12AB_021 (mRNA with T100 tail)
  modified_base (1)..(1): g is a 5 terminal guanosine cap
ggggaaauaagagagaaaagaagaguaagaagaaauauaagagccaccaugugccaccagcagcuggugaucagcugguucagccugguguuccuggccagcccucugguugccaucugggagcugaagaaagacguguacgucguggaacuggacugguauccggacgccccgggcgagaugguggugcugaccugugacacccccgaggaggacggcaucaccuggacgcuggaccaauccuccgaggugcugggaagcggcaagacccugaccauccaggugaaggaauucggggacgccgggcaguacaccugccacaaggggggcgaagugcugucccacucgcugcugcuccugcauaagaaggaggauggaaucugguccaccgacauccucaaagaucagaaggagcccaagaacaagacguuccugcgcugugaagccaagaauuauucggggcgauucacgugcugguggcugacaaccaucagcaccgaccugacguuuagcgugaagagcagcaggggguccagcgacccccagggcgugacgugcggcgccgccacccucuccgccgagagggugcggggggacaauaaggaguacgaguacagcguggaaugccaggaggacagcgccugccccgccgcggaggaaagccucccgauagaggugaugguggacgccgugcacaagcucaaguaugagaauuacaccagcagcuuuuucauccgggacauuaucaagcccgaccccccgaagaaccuccagcugaagccccugaagaacagccggcagguggaagucuccugggaguaucccgacaccuggagcaccccgcacagcuacuucucccugaccuucugugugcaggugcagggcaaguccaagagggaaaagaaggacaggguuuucaccgacaagaccagcgcgaccgugaucugccggaagaacgccagcauaagcguccgcgcccaagauagguacuacagcagcuccuggagcgagugggcuagcgugcccugcagcgggggcgggggugggggcuccaggaaccugccaguggcgacccccgaccccggcauguuccccugccuccaucacagccagaaccugcugagggccgucagcaauaugcugcagaaggccaggcagacccuggaauucuaccccugcacgucggaggagaucgaucacgaggauaucacaaaagacaagacuuccaccguggaggccugccugccccuggagcucaccaagaaugaguccugucugaacucccgggaaaccagcuucaucaccaacggguccugccuggccagcaggaagaccagcuuuaugauggcccugugccugucgagcaucuacgaggaccugaagauguaccaggucgaguucaagacaaugaacgccaagcugcugauggaccccaagaggcaaaucuuccuggaccagaauaugcuugccgucaucgacgagcucaugcaggcccugaacuucaacuccgagaccgugccccagaagagcagccuggaggagcccgacuucuacaagaccaagaucaagcugugcauccugcugcacgcguucaggauccgggcagucaccaucgaccgugugauguccuaccugaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 162 - RNA, 1890 nt, Artificial Sequence
  Synthetic: hIL12AB_022 (mRNA with T100 tail)
  modified_base (1)..(1): g is a 5 terminal guanosine cap
ggggaaauaagagagaaaagaagaguaagaagaaauauaagagccaccaugugccaucagcagcuggugaucagcugguucagccugguguuccucgccucuccccugguggccaucugggagcucaaaaaggacguguacgugguggagcucgacugguacccagacgcccccggggagaugguggugcugaccugcgacacccccgaagaagacggcaucacguggacccucgaccaguccagcgaggugcuggggagcgggaagacucugaccauccaggucaaggaguucggggacgccgggcaguacacgugccacaagggcggcgaagucuuaagccacagccugcuccugcugcacaagaaggaggacgggaucugguccacagacauacugaaggaccagaaggagccgaagaauaaaaccuuucugaggugcgaggccaagaacuauuccggcagguucacgugcugguggcuuacaacaaucagcacagaccugacguucagcgugaaguccagccgcggcagcagcgacccccagggggugaccugcggcgccgccacccugagcgccgagcgggugcgcggggacaacaaggaguacgaguacuccguggagugccaggaagacagcgccugucccgccgccgaagagagccugccuaucgaggucaugguagaugcagugcauaagcugaaguacgagaacuauacgagcagcuuuuucauacgcgacaucaucaagcccgacccccccaagaaccugcagcuuaagccccugaagaauagccggcagguggaggucuccugggaguaccccgacaccuggucaacgccccacagcuacuucucccugaccuuuuguguccaaguccagggaaagagcaagagggagaagaaagaucggguguucaccgacaagaccuccgccacggugaucugcaggaagaacgccagcaucuccgugagggcgcaagacagguacuacuccagcagcugguccgaaugggccagcgugcccugcuccggcggcgggggcggcggcagccgaaaccuacccguggccacgccggaucccggcauguuucccugccugcaccacagccagaaccuccugagggccguguccaacaugcugcagaaggccaggcagacucuggaguucuaccccugcacgagcgaggagaucgaucacgaggacaucaccaaggauaagaccagcacuguggaggccugccuuccccuggagcugaccaagaacgagagcugucugaacuccagggagaccucauucaucaccaacggcuccugccuggccagcaggaaaaccagcuucaugauggccuugugucucagcuccaucuacgaggaccugaagauguaucaggucgaguucaagacaaugaacgccaagcugcugauggaccccaaaaggcagaucuuccuggaccagaacaugcuggccgucaucgacgagcugaugcaggcccugaacuucaacagcgagacggugccccagaaaagcucccuggaggagcccgacuucuacaagaccaagaucaagcugugcauccugcugcacgccuucaggaucagggcagugaccaucgaccgggugaugucauaccuuaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 163 - RNA, 1890 nt, Artificial Sequence
  Synthetic: hIL12AB_023 (mRNA with T100 tail)
  modified_base (1)..(1): g is a 5 terminal guanosine cap
ggggaaauaagagagaaaagaagaguaagaagaaauauaagagccaccaugugccaucagcagcuggugaucuccugguucagccugguguuucuggccucgccccuggucgccaucugggagcugaagaaagacguguacgucgucgaacuggacugguaccccgacgcccccggggagaugguggugcugaccugcgacacgccggaggaggacggcaucaccuggacccuggaucaaagcagcgaggugcugggcagcggcaagacccugaccauccaagugaaggaauucggcgaugccggccaguacaccugucacaaagggggcgaggugcucagccacagccugcugcugcugcacaagaaggaggauggcaucuggagcaccgauauccugaaggaccagaaagagcccaagaacaagacguuccugaggugcgaggccaagaacuacagcgguagguucacguguugguggcugaccaccaucagcaccgaccugacguucagcgugaagagcuccaggggcagcuccgacccacagggggugacgugcggggccgcaacccucagcgccgaaagggugcggggggacaacaaggaguacgaauacuccguggagugccaggaagauucggccugccccgccgcggaggagagccuccccaucgagguaaugguggacgccgugcauaagcugaaguacgagaacuacaccagcucguucuucauccgagacaucaucaaacccgacccgcccaaaaaucugcagcucaagccccugaagaacuccaggcagguggaggugagcugggaguaccccgacaccugguccaccccgcacagcuacuucucccugacauucugcgugcaggugcagggcaagagcaagcgggagaagaaggacaggguguucaccgacaagacgagcgccaccgugaucugccgaaagaacgccagcaucucggugcgcgcccaggauagguacuauuccagcuccuggagcgagugggccucgguacccugcagcggcggcgggggcggcggcaguaggaaucugcccguggcuaccccggacccgggcauguuccccugccuccaccacagccagaaccugcugagggccgugagcaacaugcugcagaaggccagacagacgcuggaguucuaccccugcacgagcgaggagaucgaccacgaggacaucaccaaggauaaaacuuccaccgucgaggccugccugcccuuggagcugaccaagaaugaauccugucugaacagcagggagaccucguuuaucaccaauggcagcugccucgccuccaggaagaccagcuucaugauggcccucugucugagcuccaucuaugaggaccugaagauguaccagguggaguucaagaccaugaacgcgaagcugcugauggaccccaagaggcagaucuuccuggaucagaauaugcuggcggugaucgacgagcucaugcaggcccucaauuucaauagcgagacagugccccagaaguccucccuggaggagcccgacuucuacaagaccaagaucaagcuguguauccugcugcacgccuuccggauccgggccgucaccaucgaccgggucaugagcuaccucaaugccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 164 - RNA, 1890 nt, Artificial Sequence
  Synthetic: hIL12AB_024 (mRNA with T100 tail)
  modified_base (1)..(1): g is a 5 terminal guanosine cap
ggggaaauaagagagaaaagaagaguaagaagaaauauaagagccaccaugugccaccagcagcuggugaucuccugguucucccugguguuccuggccucgccccugguggccaucugggagcugaagaaggacguguacgucguggagcucgacugguaccccgacgccccuggcgagaugguggugcugaccugcgacaccccagaggaggauggcaucaccuggacccuggaucaguccuccgaggugcugggcuccggcaagacgcugaccauccaagugaaggaguucggugacgccggacaguauaccugccauaagggcggcgagguccugucccacagccuccuccuccugcauaagaaggaggacggcaucuggagcaccgacauccugaaggaccagaaggagcccaagaacaagaccuuucugaggugcgaggccaagaacuacagcggccgauucaccugcugguggcucaccaccauauccaccgaccugacuuucuccgucaaguccucccggggguccagcgacccccagggagugaccugcggcgccgccacccucagcgccgagcgggugcggggggacaacaaggaguacgaauacuccgucgagugccaggaggacuccgccugcccggccgccgaggagagccugcccaucgaggugauggucgacgcggugcacaagcugaaguacgagaacuacaccagcaguuucuucaucagggauaucaucaagccagaucccccgaagaaucugcaacugaagccgcugaaaaacucacgacagguggaggugagcugggaguaccccgacacguggagcaccccacauuccuacuucagccugaccuucugcgugcagguccagggcaagagcaagcgggagaagaaggacaggguguucacggauaagaccagugccaccgugaucugcaggaagaacgccucuauuagcgugagggcccaggaucgguauuacuccucgagcuggagcgaaugggccuccgugcccugcagugggggggguggaggcgggagcaggaaccugcccguagcaacccccgaccccgggauguuccccugucugcaccacucgcagaaccugcugcgcgcggugagcaacaugcuccaaaaagcccgucagaccuuagaguucuaccccugcaccagcgaagaaaucgaccacgaagacaucaccaaggacaaaaccagcaccguggaggcgugccugccgcuggagcugaccaagaacgagagcugccucaacuccagggagaccagcuuuaucaccaacggcucgugccuagccagccggaaaaccagcuucaugauggcccugugccugagcuccauuuacgaggaccugaagauguaucagguggaguucaagaccaugaaugccaaacuccugauggaccccaagaggcagaucuuccuggaccagaacaugcucgcggugaucgaugagcugaugcaggcccugaacuuuaauagcgagaccgugccccagaaaagcagccuggaggagccggacuucuacaagaccaaaaucaagcugugcauccugcuccacgccuuccgcauccgggccgugaccaucgacagggugaugagcuaccugaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 165 - RNA, 1890 nt, Artificial Sequence
  Synthetic: hIL12AB_025 (mRNA with T100 tail)
  modified_base (1)..(1): g is a 5 terminal guanosine cap
ggggaaauaagagagaaaagaagaguaagaagaaauauaagagccaccaugugccaucagcagcuggugauuuccugguucucccugguguuccuggccagcccccucguggcgaucugggagcuaaagaaggacguguacgugguggagcuggacugguacccggacgcacccggcgagauggucguucugaccugcgauacgccagaggaggacggcaucaccuggacccucgaucagagcagcgagguccuggggagcggaaagacccugaccauccaggucaaggaguucggcgacgccggccaguacaccugccacaaagguggcgagguccugagccacucgcugcugcuccugcauaagaaggaggacggaaucuggagcacagacauccugaaagaccagaaggagcccaagaacaagaccuuccugaggugcgaggccaagaacuacagcgggcgcuucacgugcugguggcugaccaccaucagcacggaccucaccuucuccgugaagagcagccggggauccagcgauccccaaggcgucaccugcggcgcggccacccugagcgcggagagggucaggggcgauaauaaggaguaugaguacagcguggagugccaggaggacagcgccugcccggccgccgaggagucccugccaaucgaagugauggucgacgccgugcacaagcugaaguacgagaacuacaccagcagcuucuucauccgggauaucaucaagcccgaucccccgaagaaccugcagcugaagccccucaagaacagccggcagguggaggugaguugggaguaccccgacaccuggucaacgccccacagcuacuucucccugaccuucugugugcaggugcagggaaagagcaagagggagaagaaagaccgggucuucaccgacaagaccagcgccacggugaucugcaggaagaacgcaagcaucuccgugagggcccaggacagguacuacagcuccagcugguccgaaugggccagcgugcccuguagcggcggcgggggcgguggcagccgcaaccucccaguggccacccccgaccccggcauguuccccugccugcaccacagccagaaucugcugagggccgugaguaacaugcugcagaaggcaaggcaaacccucgaauucuaucccugcaccuccgaggagaucgaccacgaggauaucaccaaggacaagaccagcaccgucgaggccugucucccccuggagcugaccaagaaugagagcugccugaacagccgggagaccagcuucaucaccaacgggagcugccuggccuccaggaagaccucguucaugauggcgcugugccucucaagcauauacgaggaucugaagauguaccagguggaguuuaagacgaugaacgccaagcugcugauggacccgaagaggcagaucuuccuggaccagaacaugcuggccgugauagacgagcucaugcaggcccugaacuucaacuccgagaccgugccgcagaagucaucccucgaggagcccgacuucuauaagaccaagaucaagcugugcauccugcuccacgccuuccggauaagggccgugacgaucgacagggugaugagcuaccuuaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 166 - RNA, 1890 nt, Artificial Sequence
  Synthetic: hIL12AB_026 (mRNA with T100 tail)
  modified_base (1)..(1): g is a 5 terminal guanosine cap
ggggaaauaagagagaaaagaagaguaagaagaaauauaagagccaccaugugccaccagcagcucgugaucagcugguucucccugguguuucucgccagcccccugguggccaucugggagcugaagaaggacguguacgugguggagcuggacugguacccugacgccccgggggagauggucgugcugaccugcgacacccccgaagaggacgguaucaccuggacccuggaccaguccagcgaggugcugggcagcggcaagacccugacuauucaagucaaggaguucggagacgccggccaguacaccugccacaaggguggagagguguuaucacacagccugcugcugcugcacaagaaggaagacgggaucuggagcaccgacauccugaaggaccagaaggagcccaaaaacaagaccuuccugcggugcgaggccaagaacuauucgggccgcuuuacgugcugguggcugaccaccaucagcacugaucucaccuucagcgugaaguccucccgggggucguccgacccccagggggugaccugcggggccgccacccuguccgccgagagagugaggggcgauaauaaggaguacgaguacagcguugagugccaggaagauagcgccugucccgccgccgaggagagccugcccaucgaggugaugguggacgccguccacaagcugaaguaugagaacuacaccucaagcuucuucaucagggacaucaucaaacccgauccgcccaagaaucugcagcugaagccccugaaaaauagcaggcagguggaggugagcugggaguaccccgacaccugguccaccccccauagcuauuucucccugacguucugcgugcaggugcaagggaagagcaagcgggagaagaaggaccggguguucaccgacaagaccuccgccaccgugaucuguaggaagaacgcgucgaucucggucagggcccaggacagguauuacagcagcagcuggagcgagugggcgagcgugcccugcucgggcggcggcggcggcgggagcagaaaucugcccguggccaccccagaccccggaauguuccccugccugcaccauucgcagaaccuccugagggccgugagcaacaugcugcagaaggcccgccagacgcuggaguucuaccccugcacgagcgaggagaucgaccacgaagacaucaccaaggacaaaaccagcaccguggaggccugccugccccuggagcugaccaaaaacgaauccugccucaacagccgggagaccagcuucaucaccaacggcagcugccuggccagccgaaagaccuccuucaugauggcccucugccugagcagcaucuaugaggaucugaagauguaucagguggaguucaagaccaugaaugccaagcugcugauggaccccaagaggcagauauuccuggaccagaauaugcuggccgugaucgacgagcugaugcaggcccugaacuucaacagcgagaccgucccccagaaguccagccuggaggagccggacuuuuacaaaacgaagaucaagcugugcauacugcugcacgccuucaggauccgggccgugacaaucgacagggugauguccuaccugaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 167 - RNA, 1890 nt, Artificial Sequence
  Synthetic: hIL12AB_027 (mRNA with T100 tail)
  modified_base (1)..(1): g is a 5 terminal guanosine cap
ggggaaauaagagagaaaagaagaguaagaagaaauauaagagccaccaugugucaccagcagcuggugaucagcugguucucccugguguuccuggccagcccccugguggccaucugggagcucaagaaggacgucuacgucguggagcuggauugguaccccgacgcucccggggagaugguggugcugaccugcgacacccccgaggaggacggcaucaccuggacgcuggaccagagcucagaggugcugggaagcggaaagacacugaccauccaggugaaggaguucggggaugccgggcaguauaccugccacaagggcggcgaagugcugagccauucccugcugcugcugcacaagaaggaggacggcauaugguccaccgacauccugaaggaucagaaggagccgaagaauaaaaccuuccugaggugcgaggccaagaauuacagcggccgauucaccugcugguggcugaccaccaucagcaccgaccugaccuucagugugaaguccucacggggcagcucagauccccagggcgugaccugcggggccgcgacacucagcgccgagcgggugaggggugauaacaaggaguacgaguauucuguggagugccaggaagacuccgccugucccgccgccgaggagucccugcccaucgaggugaugguggacgccgugcauaaacugaaguacgagaacuacaccuccagcuucuucauccgggauauaaucaagcccgacccuccgaaaaaccugcagcugaagccccuuaaaaacagccggcagguggaggugagcugggaguaccccgacaccuggagcaccccccauagcuauuucagccugaccuucugcgugcaggugcaggggaaguccaagcgcgagaaaaaggaccggguguucaccgacaagacgagcgccaccgugaucugccggaagaacgccaguauaagcguaagggcccaggauagguacuacagcuccagcuggucggagugggccuccgugcccuguuccggcggcgggggggguggcagcaggaaccuccccguggccacgccggaccccggcauguucccgugccugcaccacucccaaaaccuccugcgggccgucagcaacaugcugcaaaaggcgcggcagacccuggaguuuuaccccuguaccuccgaagagaucgaccacgaggauaucaccaaggauaagaccuccaccguggaggccugucucccccuggagcugaccaagaacgagagcugucuuaacagcagagagaccucguucauaacgaacggcuccugccucgcuuccaggaagacgucguucaugauggcgcugugccuguccagcaucuacgaggaccugaagauguaucaggucgaguucaaaaccaugaacgccaagcugcugauggaccccaagaggcagaucuuccuggaccagaacaugcucgccgugaucgacgagcugaugcaggcccugaacuucaacagcgaaaccgugccccagaagucaagccuggaggagccggacuucuauaagaccaagaucaagcuguguauccugcuacacgcuuuucguauccgggccgugaccaucgacaggguuaugucguacuugaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 168 - RNA, 1890 nt, Artificial Sequence
  Synthetic: hIL12AB_028 (mRNA with T100 tail)
  modified_base (1)..(1): g is a 5 terminal guanosine cap
ggggaaauaagagagaaaagaagaguaagaagaaauauaagagccaccaugugccaccaacagcucgugaucagcugguucagccugguguuccuggccagcccgcugguggccaucugggagcugaagaaggacguguacgugguggagcuggacugguaccccgacgcccccggcgagauggugguccugaccugcgacacgccggaagaggacggcaucaccuggacccuggaucaguccagcgaggugcugggcuccggcaagacccugaccauucaggugaaggaguucggcgacgccggucaguacaccugccacaagggcggcgaggugcugagccacagccuacugcuccugcacaaaaaggaggauggaaucugguccaccgacauccucaaggaccagaaggagccgaagaacaagacguuccuccggugcgaggccaagaacuacagcggcagguuuaccugcugguggcugaccaccaucagcaccgaccugacauuuuccgugaagagcagccgcggcagcagcgauccccagggcgugaccugcggggcggccacccuguccgccgagcgugugaggggcgacaacaaggaguacgaguacagcguggaaugccaggaggacagcgccugucccgccgccgaggagagccugccaaucgaggucaugguggacgccgugcacaagcugaaguacgagaacuacacgagcagcuucuucaucagggacaucaucaaaccggacccgcccaagaaccugcagcugaaacccuugaaaaacagcaggcagguggaagugucuugggaguaccccgacaccugguccaccccccacagcuacuuuagccugaccuucugugugcagguccagggcaaguccaagagggagaagaaggacaggguguucaccgacaaaaccagcgccaccgugaucugcaggaagaacgccuccaucagcgugcgggcccaggacagguauuacagcucgucguggagcgagugggccagcgugcccugcuccgggggaggcggcggcggaagccggaaucugcccguggccacccccgaucccggcauguucccgugucugcaccacagccagaaccugcugcgggccgugagcaacaugcugcagaaggcccgccaaacccuggaguucuaccccuguacaagcgaggagaucgaccaugaggacauuaccaaggacaagaccagcaccguggaggccugccugccccucgagcucacaaagaacgaauccugccugaauagccgcgagaccagcuuuaucacgaacggguccugccucgccagccggaagacaagcuucaugauggcccugugccugagcagcaucuacgaggaccugaaaauguaccaaguggaguucaaaacgaugaacgccaagcugcugauggaccccaagcgccagaucuuccuggaccagaacaugcuggccgucaucgacgagcucaugcaggcccugaacuucaacagcgagaccgugccccagaagagcagccuggaggagcccgacuucuacaagacgaagaucaagcucugcauccugcugcacgcuuuccgcauccgcgcggugaccaucgaccgggugaugagcuaccucaacgccaguugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 169 - RNA, 1890 nt, Artificial Sequence
  Synthetic: hIL12AB_029 (mRNA with T100 tail)
  modified_base (1)..(1): g is a 5 terminal guanosine cap
ggggaaauaagagagaaaagaagaguaagaagaaauauaagagccaccaugugccaccaacagcuggugaucagcugguucagccugguguuucuggccuccccucugguggccaucugggagcugaagaaggacguguacgugguggagcuggacugguacccugacgcccccggcgaaaugguggugcugacgugcgacacccccgaggaggauggcaucaccuggacccuggaccaaagcagcgagguccucggaagcggcaagacccucacuauccaagugaaggaguucggggaugcgggccaguacaccugccacaagggcggcgaggugcugucucauagccugcugcuccugcauaagaaggaagacggcaucuggagcaccgacauacugaaggaucagaaggagcccaagaacaagaccuuccugaggugcgaggccaagaacuacuccgggcgcuucaccuguugguggcugaccaccaucuccaccgaccugaccuucagcgugaagagcagcagggggagcagcgacccccagggggugaccugcggagccgcgaccuugucggccgagcgggugaggggcgacaauaaggaguacgaguacucggucgaaugccaggaggacuccgccugccccgccgccgaggagucccuccccaucgaagugaugguggacgccguccacaagcugaaguacgagaacuacaccagcagcuucuucauacgggauaucaucaagcccgaccccccgaagaaccugcagcugaaacccuugaagaacuccaggcagguggaggugagcugggaguaccccgacaccugguccaccccgcacucauacuucagccugaccuucuguguacagguccagggcaagagcaagagggaaaagaaggauaggguguucaccgacaagaccuccgccacggugaucugucggaaaaacgccagcaucuccgugcgggcccaggacagguacuauuccagcagcuggagcgagugggccuccguccccugcuccggcggcgguggcgggggcagcaggaaccuccccguggccacccccgaucccgggauguucccaugccugcaccacagccaaaaccugcugagggccgucuccaauaugcugcagaaggcgaggcagacccuggaguucuaccccuguaccuccgaggagaucgaccacgaggauaucaccaaggacaagaccuccacggucgaggcgugccugccccuggagcucacgaagaacgagagcugccuuaacuccagggaaaccucguuuaucacgaacggcagcugccuggcgucacggaagaccuccuuuaugauggcccuaugucuguccucgaucuacgaggaccugaagauguaccagguggaguucaagaccaugaacgccaagcugcugauggaucccaagaggcagauuuuccuggaccagaacaugcuggccgugauugacgagcugaugcaggcgcugaacuucaacagcgagacagugccgcagaagagcucccuggaggagccggacuuuuacaagaccaagauaaagcugugcauccugcuccacgccuucagaauacgggccgucaccaucgauagggugaugucuuaccugaacgccuccugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 170 - RNA, 1890 nt, Artificial Sequence
  Synthetic: hIL12AB_030 (mRNA with T100 tail)
  modified_base (1)..(1): g is a 5 terminal guanosine cap
ggggaaauaagagagaaaagaagaguaagaagaaauauaagagccaccaugugccaccagcagcuggugauuagcugguuuagccugguguuccuggcaagcccccugguggccaucugggaacugaaaaaggacguguacguggucgagcuggauugguaccccgacgcccccggcgaaaugguggugcugacgugugauacccccgaggaggacgggaucaccuggacccuggaucagagcagcgaggugcuggggagcgggaagacccugacgauccaggucaaggaguucggcgacgcugggcaguacaccugucacaagggcggggaggugcugucccacucccugcugcuccugcauaagaaagaggacggcaucugguccaccgacauccucaaggaccagaaggagcccaagaacaagaccuuccugcggugugaggcgaagaacuacagcggccguuucaccugcugguggcugacgacaaucagcaccgacuugacguucuccgugaaguccuccagaggcagcuccgacccccaaggggugacgugcggcgcggccacccugagcgccgagcgggugcggggggacaacaaggaguacgaguacuccguggagugccaggaggacagcgccugucccgcagccgaggagucccugcccaucgaagucaugguggacgccguccacaagcugaaguacgagaacuacaccagcagcuucuucauccgcgauaucaucaagcccgauccccccaaaaaccugcaacugaagccgcugaagaauagcaggcagguggagguguccugggaguacccggacaccuggagcacgccccacagcuauuucagccugaccuuuugcgugcagguccaggggaagagcaagcgggagaagaaggaccgcguguuuacggacaaaaccagcgccaccgugaucugcaggaagaacgccagcaucagcgugagggcccaggacagguacuacagcagcuccuggagcgagugggccuccgugcccuguuccggaggcggcgggggcgguucccggaaccucccgguggccacccccgacccgggcauguucccgugccugcaccacucacagaaucugcugagggccgugagcaauaugcugcagaaggcaaggcagacccuggaguuuuaucccugcaccagcgaggagaucgaccacgaagacaucaccaaggacaagaccagcacaguggaggccugccugccccuggaacugaccaagaacgaguccugucugaacucccgggaaaccagcuucauaaccaacggcuccugucucgccagcaggaagaccagcuucaugauggcccugugccucagcuccaucuacgaggaccucaagauguaccagguugaguucaagaccaugaacgccaagcuccugauggaccccaagaggcagaucuuccuggaccagaauaugcuggccgugaucgaugaguuaaugcaggcgcugaacuucaacagcgagacggugccccaaaaguccucgcuggaggagcccgacuucuacaagaccaagaucaagcugugcauccuccugcacgccuuccgaauccgggccguaaccaucgacagggugaugagcuaucucaacgccuccugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 171 - RNA, 1890 nt, Artificial Sequence
  Synthetic: hIL12AB_031 (mRNA with T100 tail)
  modified_base (1)..(1): g is a 5 terminal guanosine cap
ggggaaauaagagagaaaagaagaguaagaagaaauauaagagccaccaugugccaccagcagcucgugaucagcugguucucgcuuguguuccuggccuccccccucgucgccaucugggagcugaagaaagacguguacgugguggagcuggacugguaucccgacgccccgggggagaugguggugcugaccugcgacaccccggaagaggacggcaucaccuggacgcucgaccagucguccgaagugcuggggucgggcaagacccucaccauccaggugaaggaguucggagacgccggccaguacaccugucauaaggggggggaggugcugagccacagccuccugcuccugcacaaaaaggaggacggcaucuggagcaccgauauccucaaggaccagaaggagcccaagaacaagacguuccugaggugugaggccaagaacuacagcgggcgguucacguguugguggcucaccaccaucuccaccgaccucaccuucuccgugaagucaagcaggggcagcuccgacccccaaggcgucaccugcggcgccgccacccugagcgccgagagggucaggggggauaacaaggaauacgaguacaguguggagugccaagaggauagcgccugucccgccgccgaagagagccugcccaucgaagugaugguggacgccgugcacaagcugaaguacgagaacuacaccuccagcuucuucaucagggauaucaucaagcccgauccccccaagaaccugcagcugaagccccugaagaacagcaggcagguggaggugagcugggaguaucccgacacguggagcaccccgcacagcuacuucucgcugaccuucugcgugcaggugcaagggaaguccaagagggagaagaaggauaggguguucaccgacaaaacgagcgccaccgugaucugccggaagaaugccagcaucucugugagggcccaggacagguacuauuccagcuccuggucggagugggccagcgugcccuguagcggcgggggcgggggcggcagcaggaaccucccgguugccacccccgaccccggcauguuuccgugccugcaccacucgcaaaaccugcugcgcgcggucuccaacaugcugcaaaaagcgcgccagacgcuggaguucuaccccugcaccagcgaggagaucgaucaugaagauaucaccaaagacaagaccucgaccguggaggccugccugccccuggagcucaccaagaacgaaagcugccugaacagcagggagacaagcuucaucaccaacggcagcugccuggccucccggaagaccagcuucaugauggcccugugccuguccagcaucuacgaggaucugaagauguaccaaguggaguuuaagaccaugaacgccaagcuguuaauggaccccaaaaggcagaucuuccuggaucagaacaugcuggccgucaucgacgagcugaugcaagcccugaacuucaacagcgagacggugccccagaagagcagccucgaggagcccgacuucuauaagaccaagauaaagcugugcauucugcugcacgccuucagaaucagggccgugaccaucgauagggugaugagcuaccugaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 172 - RNA, 1890 nt, Artificial Sequence
  Synthetic: hIL12AB_032 (mRNA with T100 tail)
  modified_base (1)..(1): g is a 5 terminal guanosine cap
ggggaaauaagagagaaaagaagaguaagaagaaauauaagagccaccaugugucaccagcagcuggugauuuccugguucagucugguguuucuugccagcccccugguggccaucugggagcugaagaaagacguauacgucguggagcuggacugguaucccgacgcucccggcgagauggugguccucaccugcgacaccccagaggaggacggcaucaccuggacccuggaccagagcuccgagguccugggcagcgguaagacccucaccauccaggugaaggaguuuggugaugccgggcaguauaccugccacaagggcggcgaggugcugucccacagccuccuguuacugcauaagaaggaggauggcaucuggagcaccgacauccucaaggaccagaaagagcccaagaacaagaccuuucugcggugcgaggcgaaaaauuacuccggccgguucaccugcugguggcugaccaccaucagcacggaccugacguucuccgugaagucgagcagggggagcuccgauccccagggcgugaccugcggcgcggccacccugagcgccgagcgcguccgcggggacaauaaggaauacgaauauagcguggagugccaggaggacagcgccugccccgcggccgaggagagccucccgaucgaggugaugguggaugccguccacaagcucaaauacgaaaacuacaccagcagcuucuucauuagggacaucaucaagcccgacccccccaaaaaccugcagcugaagccccugaagaacagccgccaggucgaggugucaugggaguacccagacaccuggagcaccccccacuccuacuucagccugaccuucugcguccaggugcagggaaaguccaaacgggagaagaaggauagggucuuuaccgauaagacgucggccaccgucaucugcaggaagaacgccagcauaagcgugcgggcgcaggaucgguacuacagcucgagcugguccgaaugggccuccgugcccuguagcggaggggguggcgggggcagcaggaaccugcccguggccaccccggacccgggcauguuucccugccugcaucacagucagaaccugcugagggccgugagcaacaugcuccagaaggcccgccagacccuggaguuuuaccccugcaccagcgaagagaucgaucacgaagacaucaccaaagacaagaccuccaccguggaggccugucugccccuggagcugaccaagaacgagagcugucugaacagcagggagaccuccuucaucaccaacggcuccugccuggcaucccggaagaccagcuucaugauggcccugugucugagcucuaucuacgaggaccugaagauguaccaggucgaguucaagaccaugaacgccaagcugcugauggaccccaagcgacagauauuccuggaccagaacaugcucgccgugaucgaugaacugaugcaagcccugaacuucaauagcgagaccgugccccagaaaagcagccuggaggagcccgacuucuacaagaccaagaucaaacugugcauacugcugcacgcguucaggauccgggccgucaccaucgaccgggugauguccuaucugaaugccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 173 - RNA, 1890 nt, Artificial Sequence
  Synthetic: hIL12AB_033 (mRNA with T100 tail)
  modified_base (1)..(1): g is a 5 terminal guanosine cap
ggggaaauaagagagaaaagaagaguaagaagaaauauaagagccaccaugugccaccagcagcucgugauuagcugguuuucgcugguguuccuggccagcccucucguggccaucugggagcugaaaaaagacguguacgugguggagcuggacugguacccggacgcccccggcgagaugguggugcugacgugcgacaccccggaagaggacggcaucaccuggacccuggaccagucauccgagguccugggcagcggcaagacgcucaccauccaggugaaggaguucggcgacgccggccaguacacaugccauaagggcggggaggugcugagccacagccugcuccuccugcacaagaaggaggauggcaucuggucuacagacauccugaaggaccagaaagagcccaagaacaagaccuuccuccggugcgaggccaagaacuacuccgggcgguuuacuuguugguggcugaccaccaucagcaccgaccucaccuucagcgugaagagcucccgagggagcuccgacccccagggggucaccugcggcgccgccacccugagcgccgagcgggugaggggcgacaacaaggaguaugaauacagcguggaaugccaagaggacagcgccugucccgcggccgaggaaagccugcccaucgaggugaugguggacgccguccacaaacucaaguacgagaacuacaccagcaguuucuucauucgcgacaucaucaagccggacccccccaaaaaccugcagcucaaaccccugaagaacagcaggcagguggaggucagcugggaguacccggacaccuggagcaccccccauagcuacuucagccugaccuucugcgugcaggugcagggcaagagcaaacgcgagaagaaggaccggguguuuaccgacaagaccagcgccacggugaucugccgaaagaaugcaagcaucuccgugagggcgcaggaccgcuacuacucuagcagcuggagcgagugggccagcgugcccugcagcgguggcggcggaggcggcagccguaaccuccccguggccacccccgaccccggcauguucccgugucugcaccacucccagaaccugcugagggccgucagcaauaugcugcagaaggcccggcagacgcuggaguucuaccccugcaccuccgaggagaucgaccaugaggacauuaccaaggacaagacgagcacuguggaggccugccugccccuggagcucaccaaaaacgagagcugccugaauagcagggagacguccuucaucaccaacggcagcugucuggccagcaggaagaccagcuucaugauggcccugugccucuccuccauauaugaggaucugaagauguaccagguggaguucaagaccaugaacgccaagcugcugauggaucccaagaggcagaucuuccuggaccagaauaugcuggccgugauugacgagcugaugcaggcccugaacuuuaauagcgagaccgucccccagaagagcagccuggaggagcccgacuucuauaagaccaagaucaagcugugcauacugcugcacgcguuuaggauaagggccgucaccaucgacagggugaugagcuaccugaaugccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 174 - RNA, 1890 nt, Artificial Sequence
  Synthetic: hIL12AB_034 (mRNA with T100 tail)
  modified_base (1)..(1): g is a 5 terminal guanosine cap
ggggaaauaagagagaaaagaagaguaagaagaaauauaagagccaccaugugccaccaacagcuggugaucuccugguucagccugguguuccucgccagcccccugguggccaucugggagcugaagaaagacguguacgugguggagcuggacugguaucccgacgcccccggcgagauggucgugcugaccugcgacaccccggaggaggacggcaucaccuggacccuggaucaguccuccgaggugcugggcagcgggaagacccugaccauccaggugaaagaguucggagaugccggccaguauaccugucacaaggggggugaggugcugagccauagccucuugcuucugcacaagaaggaggacggcaucugguccaccgacauccucaaggaccaaaaggagccgaagaauaaaacguuccugaggugcgaagccaagaacuauuccggacgguucaccugcugguggcugaccaccaucagcaccgaccucaccuucuccguaaagucaagcaggggcagcuccgacccccagggcgugaccugcggagccgccacccugagcgcagagagggugaggggcgacaacaaggaguacgaauacuccgucgagugccaggaggacagcgccugccccgccgccgaggaaagucugcccaucgaggugaugguggacgccgugcacaagcucaaauacgagaacuacaccagcagcuucuucauccgggauaucaucaagcccgacccuccaaagaaucugcagcugaaaccccuuaagaacagcaggcagguggaggucagcugggaguaccccgacaccuggagcacgccccacuccuacuuuagccugaccuuuugcgugcaggugcaggggaaaagcaagcgggagaagaaggacaggguguucaccgauaagaccuccgcuaccgugaucugcaggaagaacgccucaaucagcgugagggcccaggaucgguacuacuccagcuccuggagcgagugggccagcgugcccugcucuggcgguggcggcgggggcagccggaaccugccgguggccacucccgacccgggcauguucccgugccuccaccauucccagaaccugcugcgggccguguccaauaugcuccagaaggcaaggcagacccuggaguucuaccccugcaccagcgaggagaucgaucacgaggacaucaccaaagacaaaaccagcacggucgaggccugccugccccuggaacucaccaagaacgaaagcugucucaacagccgcgagaccagcuucauaaccaacgguuccugucuggccucccgcaagaccagcuuuaugauggcccucugucugagcuccaucuaugaagaccugaaaauguaccagguggaguucaaaaccaugaacgccaagcuucugauggaccccaagaggcagaucuuccuggaucagaacaugcuggccgugaucgacgagcugaugcaggcccugaacuuuaacuccgagaccgugccccagaaaagcagccuggaagagcccgauuucuacaaaacgaagaucaagcugugcauccugcugcacgccuuccggauccgugcggugaccaucgauagggugaugagcuaccugaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 175 - RNA, 1890 nt, Artificial Sequence
  Synthetic: hIL12AB_035 (mRNA with T100 tail)
  modified_base (1)..(1): g is a 5 terminal guanosine cap
ggggaaauaagagagaaaagaagaguaagaagaaauauaagagccaccaugugccaccaacagcugguaaucagcugguucagccugguuuuccucgcgucgccccugguggccaucugggaguuaaagaaggacguguacgugguggagcuggauugguaccccgacgccccgggcgagauggucgugcucaccugcgauacccccgaggaggacgggaucaccuggacccuggaccaauccagcgaggugcugggcagcggcaagacccugaccauacaggugaaggaauuuggggacgccgggcaguacaccugccacaagggcggggaagugcugucccacucccuccugcugcugcauaagaaggaggacggcaucuggagcaccgacauccugaaggaccaaaaggagcccaagaacaagaccuuccugaggugcgaggccaaaaacuauuccggccgcuuuaccuguugguggcugaccaccaucuccaccgaucugaccuucagcgugaagucgucuaggggcuccuccgacccccagggcguaaccugcggcgccgcgacccugagcgccgagagggugcggggcgauaacaaagaguacgaguacucgguggagugccaggaggacagcgccuguccggcggccgaggagagccugcccaucgaggugaugguggacgccguccacaagcugaaguacgagaacuacaccaguucguucuucaucagggacaucaucaagccggacccccccaagaaccuccagcugaagccccugaagaacagcaggcagguggaaguguccugggaguaucccgacaccuggagcaccccccacagcuacuucagccugaccuuuugcgugcaggugcagggcaaaagcaagagggaaaagaaggaccggguguucaccgauaagacgagcgccaccguuaucugcaggaagaacgccuccauaagcgugagggcgcaggaccguuacuacagcagcagcuggagugagugggcaagcgugcccuguagcggcgggggcgggggcgggucccgcaaccuccccgucgccacccccgacccaggcauguuuccgugccugcaccacagccagaaccugcugcgggccguuagcaacaugcugcagaaggccaggcagacccucgaguucuaucccugcacaucugaggagaucgaccacgaagacaucacuaaggauaagaccuccaccguggaggccugucugccccucgagcugaccaagaaugaauccugccugaacagccgagagaccagcuuuaucaccaacggcuccugccuggccagcaggaagaccuccuucaugauggcccugugccucuccagcaucuacgaggaucugaagauguaccagguagaguucaagacgaugaacgccaagcuccugauggaccccaagaggcagauauuccuggaccagaacaugcuggcggugaucgacgagcugaugcaggcccugaauuucaacagcgagacggugccacagaaguccagccuggaggagccagacuucuacaagaccaagaucaaacugugcauccuccugcacgcguucaggauccgcgccgucaccauagacagggugaugaguuaucugaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 176 - RNA, 1890 nt, Artificial Sequence
  Synthetic: hIL12AB_036 (mRNA with T100 tail)
  modified_base (1)..(1): g is a 5 terminal guanosine cap
ggggaaauaagagagaaaagaagaguaagaagaaauauaagagccaccaugugccaucagcagcugguaaucagcugguuuagccugguguuccuggccagcccacugguggccaucugggagcugaagaaggacguguacgugguggaacuggacugguaccccgacgccccuggcgagauggugguacugaccugugacaccccggaggaagacgguaucaccuggacccuggaucagagcuccgaggugcugggcuccggcaagacacugaccauccaaguuaaggaauuuggggacgccggccaguacaccugccacaaggggggcgaggugcugucccacucccugcugcuucugcauaagaaggaggauggcaucugguccaccgacauacugaaggaccagaaggagcccaagaauaagaccuuccugagaugcgaggccaagaacuacucgggaagguucaccugcugguggcugaccaccaucagcaccgaccugaccuucuccgugaagagcucccggggcagcuccgacccccagggcguaaccuguggggccgcuacccuguccgccgagaggguccggggcgacaacaaggaauacgaguacagcguggagugccaggaggacuccgccugccccgccgccgaggagucgcugcccauagaggugaugguggacgccgugcacaagcucaaguacgagaauuacaccagcagcuucuuuaucagggacauaauuaagccggaccccccaaagaaucugcagcugaagccccugaagaauagccggcagguggaaguguccugggaguaccccgacaccuggagcaccccccacuccuauuucucacugacauucugcgugcaggugcaagggaaaagcaagagggagaagaaggauaggguguucaccgacaagacaagcgccaccgugaucugccgaaaaaaugccagcaucagcgugagggcccaggaucgguauuacagcagcuccuggagcgagugggccagcgugcccuguuccggcgggggagggggcggcucccggaaccugccgguggccacccccgacccuggcauguuccccugccugcaucacagccagaaccugcuccgggccgugucgaacaugcugcagaaggcccggcagacccucgaguuuuaccccugcaccagcgaagagaucgaccacgaagacauaaccaaggacaagaccagcacgguggaggccugccugccccuggagcuuaccaaaaacgaguccugccugaacagccgggaaaccagcuucauaacgaacgggagcugccuggccuccaggaagaccagcuucaugauggcgcugugucuguccagcauauacgaggaucugaagauguaucagguggaauucaaaacuaugaaugccaagcuccugauggaccccaagaggcagaucuuccuggaccagaacaugcuagccgugaucgacgagcugaugcaggcccucaacuucaacucggagacggugccccagaaguccagccucgaggagcccgacuucuacaagaccaagaucaagcugugcauacugcugcaugccuucaggauaagggcggugacuaucgacagggucauguccuaccugaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 177 - RNA, 1890 nt, Artificial Sequence
  Synthetic: hIL12AB_037 (mRNA with T100 tail)
  modified_base (1)..(1): g is a 5 terminal guanosine cap
ggggaaauaagagagaaaagaagaguaagaagaaauauaagagccaccaugugccaccaacaacuggugaucagcugguucucccugguguuccuggccagcccccugguggccaucugggagcucaaaaaagacguguacgugguggagcucgauugguacccagacgcgccgggggaaaugguggugcugaccugcgacaccccagaggaggauggcaucacguggacgcuggaucaguccagcgaggugcuggggagcggcaagacgcucaccauccaggugaaggaauuuggcgacgcgggccaguauaccugucacaagggcggcgaggugcugagccacucccugcugcugcugcacaagaaggaggaugggaucuggucaaccgauauccugaaagaccagaaggagcccaagaacaagaccuuccugcgcugcgaggccaagaacuauagcggcagguucaccugcugguggcugaccaccaucagcaccgaccugaccuucagcgugaaauccuccaggggcagcagcgacccccagggcgugaccugcggugccgccacgcucuccgccgagcgagugaggggugacaacaaggaguacgaguacagcguggaaugucaggaggacagcgccugucccgccgccgaggagucgcugcccaucgaggugauggucgacgcggugcacaagcucaaauacgagaauuacaccagcagcuucuucaucagggacaucaucaagcccgacccccccaagaaccugcagcugaagcccuugaagaacagcaggcagguggaggugagcugggaguacccggacaccuggagcaccccccacuccuacuucagccugacguucugugugcaggugcaggggaaguccaagagggagaagaaggaccggguguucaccgacaagaccagcgccaccgugauaugccgcaagaacgcguccaucagcguucgcgcccaggaccgcuacuacagcagcuccugguccgaaugggccagcgugcccugcagcgguggagggggcgggggcuccaggaaucugccgguggccacccccgaccccgggauguucccgugucugcaucacucccagaaccugcugcgggccgugagcaauaugcugcagaaggccaggcagacgcucgaguucuaccccugcaccuccgaagagaucgaccaugaggacaucaccaaggacaagaccagcaccguggaggccugccucccccuggagcugaccaaaaacgagagcugccugaacuccagggagaccagcuuuauaaccaacggcagcugccucgccuccaggaagaccucguuuaugauggcccucugccuguccagcaucuacgaggaccugaagauguaccagguggaguucaagaccaugaacgcgaaguugcucauggaccccaagaggcagaucuuccuggaccagaacaugcucgcggugaucgacgagcugaugcaagcccugaacuucaacagcgagaccgugccccagaagagcagccuggaagagcccgacuucuacaagaccaagaucaagcugugcauccugcugcacgccuuccggauccgggccgugaccaucgacagggugaugagcuaccucaacgccuccugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 178 - RNA, 1890 nt, Artificial Sequence
  Synthetic: hIL12AB_038 (mRNA with T100 tail)
  modified_base (1)..(1): g is a 5 terminal guanosine cap
ggggaaauaagagagaaaagaagaguaagaagaaauauaagagccaccaugugccaccagcagcucgugaucagcugguucucccucgucuuccuggccuccccgcugguggccaucugggagcugaagaaggacguguacgugguggagcuggacugguaucccgacgcccccggcgagaugguggugcugacgugcgacacaccagaagaggacgggaucacauggacccuggaucagucguccgaggugcuggggagcggcaagacccucaccauccaagugaaggaguucggggacgccggccaguacaccugccacaagggcggggaggugcucucccauagccugcuccuccugcacaaaaaggaggauggcaucuggagcaccgacauccugaaggaccagaaggagcccaagaacaagacauuucucaggugugaggccaagaacuauucgggcagguuuaccuguugguggcucaccaccaucucuaccgaccugacguucuccgucaagucaagcagggggagcucggacccccagggggugacauguggggccgccacccugagcgcggagcguguccgcggcgacaacaaggaguacgaguauuccguggagugccaggaggacagcgccugccccgccgccgaggagucccugcccauagaggugaugguggacgccguccacaaguugaaguacgaaaauuauaccuccucguucuucauuagggacaucaucaagccugaccccccgaagaaccuacaacucaagccccucaagaacucccgccagguggagguguccugggaguaccccgacaccugguccaccccgcacagcuacuucagccugaccuucugcgugcagguccaggggaagagcaagcgugaaaagaaagacaggguguucaccgacaagacgagcgccaccgugaucugcaggaaaaacgccuccaucuccgugcgcgcccaggacagguacuacaguagcuccuggagcgaaugggccagcgugccgugcagcggcgggggaggaggcggcagucgcaaccugcccguggccacccccgaccccggcauguucccaugccugcaccacagccagaaccugcugagggcagucagcaauaugcugcagaaggccaggcagacccuggaguuuuaucccugcaccagcgaggagaucgaccacgaggacaucaccaaggacaagaccuccaccgucgaggccugccugccacuggagcugaccaaaaacgagagcugccugaacuccagggagaccuccuucaucaccaacgggagcugccuggccagccggaagaccagcuucaugauggcgcugugccucagcagcaucuacgaggaucucaagauguaccagguggaguucaagaccaugaacgcgaagcugcugauggaccccaagcggcagaucuuccuggaccagaacaugcuggccgugauugacgagcucaugcaggcccugaacuucaauagcgagaccgucccccaaaagagcagccuggaggaacccgacuucuacaaaacgaagaucaagcucugcauccugcugcacgccuuccggauccgggccgugaccaucgaucgugugaugagcuaccugaacgccucgugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 179 - RNA, 1890 nt, Artificial Sequence
  Synthetic: hIL12AB_039 (mRNA with T100 tail)
  modified_base (1)..(1): g is a 5 terminal guanosine cap
ggggaaauaagagagaaaagaagaguaagaagaaauauaagagccaccaugugccaccagcagcucgucaucuccugguuuagccugguguuucuggccuccccccuggucgccaucugggagcugaagaaagacguguacgugguggagcuggacugguacccggacgcucccggggagaugguggugcugaccugcgacacccccgaggaggacggcaucaccuggacccuggaccagagcuccgaggugcuggggagcggcaagacccugaccauucaggugaaagaguucggcgacgccggccaauauaccugccacaaggggggggagguccugucgcauucccugcugcugcuucacaaaaaggaggauggcaucuggagcaccgacauccugaaggaccagaaagaacccaagaacaagacguuccugcgcugcgaggccaagaacuacagcggccgguucaccuguugguggcugaccaccaucuccaccgaccugacuuucucggugaagagcagccgcgggagcagcgacccccagggagugaccugcggcgccgccacccugagcgccgaaagggugaggggcgacaauaaagaguacgaguauuccguggagugccaggaggacagcgccugucccgccgccgaggagucccugccuaucgaggugauggucgacgcggugcacaagcucaaguacgaaaacuacaccagcagcuuuuucaucagggauaucaucaaaccagacccccccaagaaccugcagcugaagccccugaaaaacagcaggcagguggaagugagcugggaauaccccgauaccugguccaccccccacagcuacuucagccugaccuucugcgugcaggugcaggggaaguccaagcgggagaagaaagaucggguguucacggacaagaccagcgccaccgugauuugcaggaaaaacgccagcaucuccgugagggcucaggacagguacuacagcuccagcuggagcgagugggccuccgugccuugcagcgggggaggaggcggcggcagcaggaaucugcccgucgcaacccccgaccccggcauguuccccugccugcaccacagccagaaucugcugcgagccgugagcaacaugcuccagaaggcccggcagacgcuggaguucuaccccugcaccuccgaggagaucgaccacgaggacaucaccaaggauaagacgagcaccgucgaggccugucucccccuggagcucaccaagaacgaguccugccugaauagcagggagacguccuucauaaccaacggcagcugucuggcguccaggaagaccagcuucaugauggcccucugccugagcuccaucuacgaggaccucaagauguaccaggucgaguucaagaccaugaacgcaaaacugcucauggauccaaagaggcagaucuuucuggaccagaacaugcuggccgugaucgaugaacucaugcaggcccugaauuucaauuccgagaccgugccccagaagagcucccuggaggaacccgacuucuacaaaacaaagaucaagcuguguauccuccugcacgccuuccggaucagggccgucaccauugaccgggugauguccuaccugaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 180 - RNA, 1890 nt, Artificial Sequence
  Synthetic: hIL12AB_040 (mRNA with T100 tail)
  modified_base (1)..(1): g is a 5 terminal guanosine cap
ggggaaauaagagagaaaagaagaguaagaagaaauauaagagccaccaugugccaucagcagcuggugaucagcugguucagccucguguuccucgccagcccccucguggccaucugggagcugaaaaaggacguguacgugguggagcuggacugguaucccgacgccccgggcgagaugguggugcugaccugcgacacccccgaggaggacggcauuaccuggacacuggaccagagcagcgagguccugggcagcgggaagacccugacaauucaggugaaggaguucggcgacgccggacaguacacgugccacaaggggggggaggugcugucccacagccuccuccugcugcacaagaaggaggauggcaucuggagcaccgacauccugaaggaucagaaggagcccaagaacaagaccuuucugagaugcgaggccaagaauuacagcggccguuucaccugcugguggcucaccaccaucagcaccgaccugaccuucagcgugaaauccuccaggggcuccuccgacccgcagggagugaccugcggcgccgccacacugagcgccgagcgggucagaggggacaacaaggaguacgaguacagcguugagugccaggaggacagcgccugucccgcggccgaggaaucccugcccaucgaggugaugguggacgcagugcacaagcugaaguacgagaacuauaccucgagcuucuucauccgggauaucauuaagcccgaucccccgaagaaccugcagcucaaaccccugaagaacagcaggcagguggaggucuccugggaguaccccgacacaugguccaccccccauuccuauuucucccugaccuuuugcgugcaggugcagggcaagagcaagagggagaaaaaggacaggguguucaccgacaagaccuccgccaccgugaucugccguaagaacgcuagcaucagcgucagggcccaggacagguacuauagcagcuccugguccgagugggccagcgucccgugcagcggcgggggcgguggaggcucccggaaccuccccguggccaccccggaccccgggauguuucccugccugcaucacagccagaaccugcugagggccguguccaacaugcugcagaaggccaggcagacacucgaguuuuaccccugcaccagcgaggagaucgaccacgaagacaucaccaaggacaagaccuccaccguggaggcaugccugccccuggagcugaccaaaaacgaaagcugucugaacuccagggagaccuccuuuaucacgaacggcucaugccuggccuccagaaagaccagcuucaugauggcccugugccugagcuccaucuacgaggacuugaaaauguaccaggucgaguucaagaccaugaacgccaagcugcucauggaccccaaaaggcagaucuuucuggaccagaauaugcuggccgugaucgacgagcucaugcaagcccugaauuucaacagcgagaccgugccccagaaguccucccuggaggagcccgacuucuacaagaccaagaucaagcugugcauacuccugcacgcguuuaggaucagggcggugaccaucgauagggugaugagcuaccugaaugccuccugauaauaggcuggagccucgguggccaugcuucuugccccuugggccuccccccagccccuccuccccuuccugcacccguaccccccaaacaccauugucacacuccaguggucuuugaauaaagucugagugggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 181 - DNA, 1737 bp, Artificial Sequence
  Synthetic: mIL12AB 80TM- nolinker_ V5_  Nucleotide Sequence
atgtgtcctcagaagctaaccatctcctggtttgccatcgttttgttggtgtctccactcatggccatgtgggagctcgagaaagacgtttacgttgtagaggtggactggactcccgacgccccgggcgaaacagtgaacctcacctgtgacacgcctgaagaagatgacatcacctggacctcagaccagagacatggagtcataggctctggaaagaccctgaccatcactgtcaaagagttcctagatgctggccagtacacctgccacaaaggaggcgagactctgagccactcacatctgctgctccacaagaaggagaatggaatttggtccactgagatcctgaagaacttcaagaataagactttcctgaagtgtgaagcaccaaattactccggacggttcacgtgctcatggctggtgcaaagaaacatggacttgaagttcaacatcaagagcagtagcagttcccctgactctcgggcagtgacatgtggaatggcgtctctgtctgcagagaaggtcacactggaccaaagggactatgagaagtattcagtgtcctgccaggaggatgtcacctgcccaactgccgaggagacactgcccattgaactggcgttggaagcacggcagcagaataaatatgagaactacagcaccagcttcttcatcagggacatcatcaaaccagacccgcccaagaacttgcagatgaagcctttgaagaactcacaggtggaggtcagctgggagtacccggactcctggagcactccccattcctacttctccctcaagttctttgttcgaatccagcgcaagaaagagaagatgaaggagacagaggaggggtgtaaccagaaaggtgcgttcctcgtagagaagacatctaccgaagtccaatgcaaaggcgggaatgtctgcgtgcaagctcaggatcgctattacaattcctcatgcagcaagtgggcatgtgttccctgcagggtccgatccggaggcggagggagcggtggtggaggcagcggaggaggtggatcaagggtcattccagtctctggaccagctagatgtcttagccagtcccgaaacctgctgaagaccacggacgacatggtgaagacggccagagagaaactgaaacattattcctgcaccgcagaggatatcgatcacgaagatatcacacgggaccaaaccagcacattgaagacctgtttaccactggaactacacaagaacgagagttgcctggctactagagagacttcttccacaacaagagggagctgcctgccaccacagaagacgtctttgatgatgaccctgtgccttggtagcatctatgaggacctcaagatgtaccagacagagttccaggccatcaacgcagcacttcagaatcacaaccatcagcagatcattttagacaagggcatgctggtggccatcgatgagctgatgcaatcattgaatcataacggtgagacattgcgccagaaacctcctgtgggagaagcagacccttacagagtgaagatgaagctctgcatcctgcttcacgccttcagcacccgcgtcgtcactatcaacagggtgatgggctatctgagctccgccaccctggtgctgttcggcgccggcttcggtgcagtgatcaccgtggtggtgatcgtcgtcatcatcgggaaaccaattccaaatcccctcctggggttggatagcacc

SEQ ID NO: 182 - protein, 579 aa, Artificial Sequence
  Synthetic: mIL12AB-80TM-nolinker_V5  Amino acid Sequence
MCPQKLTISWFAIVLLVSPLMAMWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSATLVLFGAGFGAVITVVVIVVIIGKPIPNPLLGLDST

SEQ ID NO: 183 - DNA, 1839 bp, Artificial Sequence
  Synthetic: mIL12AB-PTM_v5 miR122 Nucleotide Sequence
atgtgtcctcagaagctaaccatctcctggtttgccatcgttttgcttgtgtctccactcatggccatgtgggagctcgagaaagacgtttacgttgtagaggtggactggactcccgacgccccaggagaaacagtgaacctcacctgtgacacgcctgaagaagatgacatcacctggacctcagaccagagacatggagtcataggctctggaaagaccctgaccatcactgtcaaagagttcctagatgctggccagtacacctgccacaaaggaggcgagactctgagccactcacatctgctgctccacaagaaggagaatggaatttggtccaccgaaatcctgaagaacttcaagaataagactttcctgaagtgtgaagcaccaaattactccggacggttcacgtgctcatggctggtgcaaagaaacatggacttgaagttcaacatcaagagcagtagcagttcccctgactctcgggcagtgacatgtggaatggcgtctctgtctgcagagaaggtcacactggaccaaagggactatgagaagtattcagtgtcctgccaggaggatgtcacctgcccaactgccgaggaaactctgcccattgaactggcgttggaagcacggcagcagaataaatatgagaactacagcaccagcttcttcatcagggacatcatcaaaccagacccgcccaagaacttgcagatgaagcctttgaagaactcacaggtggaggtcagctgggagtacccagactcctggagcactccccattcctacttctccctcaagttctttgttcgaatccagcgcaagaaagagaagatgaaggagacagaggaggggtgtaaccagaaaggtgcgttcctcgtagagaagacatctaccgaagtccaatgcaaaggcgggaatgtctgcgtgcaagctcaggatcgctattacaattcctcatgcagcaagtgggcatgtgttccctgcagggtccgatccggaggcggagggtctggaggaggaggttctggaggtggtggcagtagggtcattccagtctctggacctgcaaggtgtcttagccagtcccgaaacctgctgaagaccacagacgatatggtgaagacggccagagagaaactgaaacattattcctgcacagcagaggacatcgatcatgaagatattacacgggaccaaaccagcacattgaagacctgtttaccactggaactacacaagaacgagagttgcctggctactagagagacttcttccacaacaagagggagctgcctgccaccacagaagacgtctttgatgatgaccctgtgccttggtagcatctacgaggatctcaagatgtaccagacagagttccaggccatcaacgcagcacttcagaatcacaaccatcagcagatcattttagacaagggcatgctggtggccatcgatgagctgatgcaatctctgaatcataatggcgagacacttcgccagaaacctcctgtgggagaagcagacccttacagagtgaagatgaagctctgcatcctgcttcacgccttcagcacccgcgtcgtcactattaacagggtgatgggctatctgagctccgcctctggtggcggatcaggcggcggcggctctggcggcggtggaagcggaggtggcgggtctggcggaggttcactgcaggtagtagtgatcagcgccatcctggccctggtggtgctgaccgtgatctcattgatcatcttgattatgctgtggggcggaggaggcagcgggaaaccaattccaaatcccctcctggggttggatagcacc

SEQ ID NO: 184 - protein, 613 aa, Artificial Sequence
  Synthetic: mIL12AB-PTM_v5 miR122 Amino Acid Sequence
MCPQKLTISWFAIVLLVSPLMAMWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSASGGGSGGGGSGGGGSGGGGSGGGSLQVVVISAILALVVLTVISLIILIMLWGGGGSGKPIPNPLLGLDST

SEQ ID NO: 185 - DNA, 1839 bp, Artificial Sequence
  Synthetic: mIL12AB-8TM_v5_miR122 Nucleotide sequence
atgtgtcctcagaagctaaccatctcctggtttgccatcgttttgttagtgtctccactcatggccatgtgggagctcgagaaagacgtttacgttgtagaggtggactggactcccgacgccccaggcgaaacagtgaacctcacctgtgacacgcctgaagaagatgacatcacctggacctcagaccagagacatggagtcataggctctggaaagaccctgaccatcactgtcaaagagttcctagatgctggccagtacacctgccacaaaggaggcgagactctgagccactcacatctgctgctccacaagaaggagaatggaatttggtccacagaaattttaaagaacttcaagaacaagactttcctgaagtgtgaagcaccaaattactccggacggttcacgtgctcatggctggtgcaaagaaacatggacttgaagttcaacatcaagagcagtagcagttcccctgactctcgggcagtgacatgtggaatggcgtctctgtctgcagagaaggtcacactggaccaaagggactatgagaagtattcagtgtcctgccaggaggatgtcacctgcccaactgccgaggagactctgcccattgaactggcgttggaagcacggcagcagaataaatatgagaactacagcaccagcttcttcatcagggacatcatcaaaccagacccgcccaagaacttgcagatgaagcctttgaagaactcacaggtggaggtcagctgggagtacccagactcctggagcactccccattcctacttctccctcaagttctttgttcgaatccagcgcaagaaagagaagatgaaggagacagaggaggggtgtaaccagaaaggtgcgttcctcgtagagaagacatctaccgaagtccaatgcaaaggcgggaatgtctgcgtgcaagctcaggatcgctattacaattcctcatgcagcaagtgggcatgtgttccctgcagggtccgatccggaggcggagggagtggaggaggtggctctggcggcggtggaagtagggtcattccagtctctggacctgcacgctgtcttagccagtcccgaaacctgctgaagaccacagacgacatggtgaagacggccagagagaaactgaaacattattcctgcacagcggaagacatagatcacgaggatatcacacgggaccaaaccagcacattgaagacctgtttaccactggaactacacaagaacgagagttgcctggctactagagagacttcttccacaacaagagggagctgcctgccaccacagaagacgtctttgatgatgaccctgtgccttggtagcatctatgaggatctgaagatgtaccagacagagttccaggccatcaacgcagcacttcagaatcacaaccatcagcagatcattttagacaagggcatgctggtggccatcgatgagctgatgcagtccctgaatcataatggtgaaacgttgcgccagaaacctcctgtgggagaagcagacccttacagagtgaagatgaagctctgcatcctgcttcacgccttcagcacccgcgtcgtgactataaacagggtgatgggctatctgagctccgcctctggtggcggatcaggaggaggtggatccggtggcggtggttccggaggtggtggatcgggtggtggctcactgcagatctacatctgggccccgctggccggcatctgcgtggccctgctgctgagcctgatcatcaccctgatctgctacggtggaggcggtagcgggaaaccaattccaaatcccctcctggggttggatagcacc

SEQ ID NO: 186 - protein, 613 aa, Artificial Sequence
  Synthetic: mIL12AB-8TM_v5_miR122 Amino Acid sequence
MCPQKLTISWFAIVLLVSPLMAMWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSASGGGSGGGGSGGGGSGGGGSGGGSLQIYIWAPLAGICVALLLSLIITLICYGGGGSGKPIPNPLLGLDST

SEQ ID NO: 187 - DNA, 6 bp, Artificial Sequence
  Synthetic: Xba1 restriction site
tctaga

SEQ ID NO: 188 - DNA, 6 bp, Artificial Sequence
  Synthetic: EcoRI
gaattc

SEQ ID NO: 189 - DNA, 5 bp, Artificial Sequence
  Synthetic: EcoRII
ccwgg

SEQ ID NO: 190 - DNA, 6 bp, Artificial Sequence
  Synthetic: HindIII
aagctt

SEQ ID NO: 191 - DNA, 20 bp, Artificial Sequence
  Synthetic: T7 RNA polymerase
  misc_feature (2)..(5): n is a, c, g, or t
  misc_feature (7)..(7): n is a, c, g, or t
  misc_feature (10)..(10): n is a, c, g, or t
  misc_feature (14)..(14): n is a, c, g, or t
  misc_feature (16)..(17): n is a, c, g, or t
  misc_feature (19)..(19): n is a, c, g, or t
gnnnnwncrnctcncnnwnd

SEQ ID NO: 192 - protein, 5 aa, Artificial Sequence
  Synthetic: Linker (amino acid sequence)
GGGGG

SEQ ID NO: 193 - protein, 10100 aa, Artificial Sequence
  Synthetic: Gly/ser linker (amino acid sequence) - (GnS)m
  misc_feature (1)..(101000): This sequence represents "(GlynSer)m" where n= 1 - 100 and m=1-100.
GGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGSGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGS

SEQ ID NO: 194 - protein, 25 aa, Artificial Sequence
  Synthetic: Gly/ser linker (amino acid sequence) - (GGGGS)o
  misc_feature (1)..(25): "Gly Gly Gly Gly Ser" is present at least one time and may or may not be present up to five times
GGGGSGGGGSGGGGSGGGGSGGGGS

SEQ ID NO: 195 - protein, 10 aa, Artificial Sequence
  Synthetic: Gly/ser linker (amino acid sequence)
GGSGGGGSGG

SEQ ID NO: 196 - protein, 8 aa, Artificial Sequence
  Synthetic: Gly/ser linker (amino acid sequence)
GGSGGGGG

SEQ ID NO: 197 - protein, 8 aa, Artificial Sequence
  Synthetic: Gly/ser linker (amino acid sequence)
GSGSGSGS

SEQ ID NO: 198 - protein, 100 aa, Artificial Sequence
  Synthetic: Gly-rich linker (amino acid sequence) - (Gly)p
  misc_feature (1)..(100): Gly is present at least one time and may or may not be present up to 100 times
GGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGGG

SEQ ID NO: 199 - protein, 500 aa, Artificial Sequence
  Synthetic: Linker (amino acid sequence) - (EAAAK)q
  misc_feature (1)..(500): "EAAAK" is present at least one time and may or may not be present up to 100 times
EAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAK

SEQ ID NO: 200 - protein, 16 aa, Artificial Sequence
  Synthetic: Linker (amino acid sequence)
GGGGSLVPRGSGGGGS

SEQ ID NO: 201 - protein, 6 aa, Artificial Sequence
  Synthetic: Linker (amino acid sequence)
GSGSGS

SEQ ID NO: 202 - protein, 15 aa, Artificial Sequence
  Synthetic: Linker (amino acid sequence)
GGGGSLVPRGSGGGG

SEQ ID NO: 203 - protein, 11 aa, Artificial Sequence
  Synthetic: Linker (amino acid sequence)
GGSGGHMGSGG

SEQ ID NO: 204 - protein, 11 aa, Artificial Sequence
  Synthetic: Linker (amino acid sequence)
GGSGGSGGSGG

SEQ ID NO: 205 - protein, 5 aa, Artificial Sequence
  Synthetic: Linker (amino acid sequence)
GGSGG

SEQ ID NO: 206 - protein, 8 aa, Artificial Sequence
  Synthetic: Linker (amino acid sequence)
GSGSGSGS

SEQ ID NO: 207 - protein, 18 aa, Artificial Sequence
  Synthetic: Linker (amino acid sequence)
GGGSEGGGSEGGGSEGGG

SEQ ID NO: 208 - protein, 8 aa, Artificial Sequence
  Synthetic: Linker (amino acid sequence)
AAGAATAA

SEQ ID NO: 209 - protein, 5 aa, Artificial Sequence
  Synthetic: Linker (amino acid sequence)
GGSSG

SEQ ID NO: 210 - protein, 11 aa, Artificial Sequence
  Synthetic: Linker (amino acid sequence)
GSGGGTGGGSG

SEQ ID NO: 211 - protein, 12 aa, Artificial Sequence
  Synthetic: Linker (amino acid sequence)
GSGSGSGSGGSG

SEQ ID NO: 212 - protein, 14 aa, Artificial Sequence
  Synthetic: Linker (amino acid sequence)
GSGGSGSGGSGGSG

SEQ ID NO: 213 - protein, 14 aa, Artificial Sequence
  Synthetic: Linker (amino acid sequence)
GSGGSGGSGGSGGS

SEQ ID NO: 214 - protein, 7 aa, Artificial Sequence
  Synthetic: Linker (amino acid sequence)
GGGGGGS

SEQ ID NO: 215 - DNA, 6 bp, Artificial Sequence
  Synthetic: Polynucleotide
atcccg

SEQ ID NO: 216 - RNA, 9 nt, Artificial Sequence
  Synthetic: Kozak consensus sequence
ccrccaugg

SEQ ID NO: 217 - protein, 6 aa, Artificial Sequence
  Synthetic: Linker (amino acid sequence)
GGGGGG

SEQ ID NO: 218 - protein, 7 aa, Artificial Sequence
  Synthetic: Linker (amino acid sequence)
GGGGGGG

SEQ ID NO: 219 - protein, 8 aa, Artificial Sequence
  Synthetic: Linker (amino acid sequence)
GGGGGGGG

SEQ ID NO: 220 - DNA, 1596 bp, Artificial Sequence
  Synthetic: hIL12AB_041 ORF
atgtgccaccagcagctggtgatcagctggttcagcctggtgttcctggccagccccctggtggccatctgggagctgaagaaggacgtgtacgtggtggagttggattggtaccccgacgcccccggcgagatggtggtgctgacctgcgacacccccgaggaggacggcatcacctggaccctggaccagagcagcgaggtgctgggcagcggcaagaccctgaccatccaggtgaaggagttcggcgacgccggccagtacacctgccacaagggcggcgaggtgctgagccacagcctgctgctgctgcacaagaaggaggacggcatctggagcaccgacatcctgaaggaccagaaggagcccaagaacaagaccttcctgagatgcgaggccaagaactacagcggcagattcacctgctggtggctgaccaccatcagcaccgacctgaccttcagcgtgaagagcagcagaggcagcagcgacccccagggcgtgacctgcggcgccgccaccctgagcgccgagagagtgagaggcgacaacaaggagtacgagtacagcgtggagtgccaggaagatagcgcctgccccgccgccgaggagagcctgcccatcgaggtgatggtggacgccgtgcacaagctgaagtacgagaactacaccagcagcttcttcatcagagatatcatcaagcccgacccccccaagaacctgcagctgaagcccctgaagaacagccggcaggtggaggtgagctgggagtaccccgacacctggagcaccccccacagctacttcagcctgaccttctgcgtgcaggtgcagggcaagagcaagagagagaagaaagatagagtgttcaccgacaagaccagcgccaccgtgatctgcagaaagaacgccagcatcagcgtgagagcccaagatagatactacagcagcagctggagcgagtgggccagcgtgccctgcagcggcggcggcggcggcggcagcagaaacctgcccgtggccacccccgaccccggcatgttcccctgcctgcaccacagccagaacctgctgagagccgtgagcaacatgctgcagaaggcccggcagaccctggagttctacccctgcaccagcgaggagatcgaccacgaagatatcaccaaagataagaccagcaccgtggaggcctgcctgcccctggagctgaccaagaacgagagctgcctgaacagcagagagaccagcttcatcaccaacggcagctgcctggccagcagaaagaccagcttcatgatggccctgtgcctgagcagcatctacgaggacctgaagatgtaccaggtggagttcaagaccatgaacgccaagctgctgatggaccccaagcggcagatcttcctggaccagaacatgctggccgtgatcgacgagctgatgcaggccctgaacttcaacagcgagaccgtgccccagaagagcagcctggaggagcccgacttctacaagaccaagatcaagctgtgcatcctgctgcacgccttcagaatcagagccgtgaccatcgacagagtgatgagctacctgaacgccagc

SEQ ID NO: 221 - RNA, 1596 nt, Artificial Sequence
  Synthetic: hIL12AB_041 mRNA ORF
augugccaccagcagcuggugaucagcugguucagccugguguuccuggccagcccccugguggccaucugggagcugaagaaggacguguacgugguggaguuggauugguaccccgacgcccccggcgagaugguggugcugaccugcgacacccccgaggaggacggcaucaccuggacccuggaccagagcagcgaggugcugggcagcggcaagacccugaccauccaggugaaggaguucggcgacgccggccaguacaccugccacaagggcggcgaggugcugagccacagccugcugcugcugcacaagaaggaggacggcaucuggagcaccgacauccugaaggaccagaaggagcccaagaacaagaccuuccugagaugcgaggccaagaacuacagcggcagauucaccugcugguggcugaccaccaucagcaccgaccugaccuucagcgugaagagcagcagaggcagcagcgacccccagggcgugaccugcggcgccgccacccugagcgccgagagagugagaggcgacaacaaggaguacgaguacagcguggagugccaggaagauagcgccugccccgccgccgaggagagccugcccaucgaggugaugguggacgccgugcacaagcugaaguacgagaacuacaccagcagcuucuucaucagagauaucaucaagcccgacccccccaagaaccugcagcugaagccccugaagaacagccggcagguggaggugagcugggaguaccccgacaccuggagcaccccccacagcuacuucagccugaccuucugcgugcaggugcagggcaagagcaagagagagaagaaagauagaguguucaccgacaagaccagcgccaccgugaucugcagaaagaacgccagcaucagcgugagagcccaagauagauacuacagcagcagcuggagcgagugggccagcgugcccugcagcggcggcggcggcggcggcagcagaaaccugcccguggccacccccgaccccggcauguuccccugccugcaccacagccagaaccugcugagagccgugagcaacaugcugcagaaggcccggcagacccuggaguucuaccccugcaccagcgaggagaucgaccacgaagauaucaccaaagauaagaccagcaccguggaggccugccugccccuggagcugaccaagaacgagagcugccugaacagcagagagaccagcuucaucaccaacggcagcugccuggccagcagaaagaccagcuucaugauggcccugugccugagcagcaucuacgaggaccugaagauguaccagguggaguucaagaccaugaacgccaagcugcugauggaccccaagcggcagaucuuccuggaccagaacaugcuggccgugaucgacgagcugaugcaggcccugaacuucaacagcgagaccgugccccagaagagcagccuggaggagcccgacuucuacaagaccaagaucaagcugugcauccugcugcacgccuucagaaucagagccgugaccaucgacagagugaugagcuaccugaacgccagc

SEQ ID NO: 222 - RNA, 138 nt, Artificial Sequence
  Synthetic: 3UTR-018 + miR-122-5p binding site
uaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 223 - RNA, 138 nt, Artificial Sequence
  Synthetic: 3UTR-018 + miR-122-3p binding site
uaauaggcuggagccucgguggccaugcuucuugccccuugggccuccccccagccccuccuccccuuccugcacccguacccccuauuuagugugauaauggcguuguggucuuugaauaaagucugagugggcggc

SEQ ID NO: 224 - RNA, 141 nt, Artificial Sequence
  Synthetic: 3UTR-019 + miR-122 binding site
ugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 225 - protein, 25 aa, Homo sapiens
  misc_feature (1)..(25): Human CD80 Intracellular Domain
TYCFAPRCRERRRNERLRRESVRPV

SEQ ID NO: 226 - protein, 550 aa, Homo sapiens
  misc_feature (1)..(550): Human PGFRB Intracellular Domain (WT)
QKKPRYEIRWKVIESVSSDGHEYIYVDPMQLPYDSTWELPRDQLVLGRTLGSGAFGQVVEATAHGLSHSQATMKVAVKMLKSTARSSEKQALMSELKIMSHLGPHLNVVNLLGACTKGGPIYIITEYCRYGDLVDYLHRNKHTFLQHHSDKRRPPSAELYSNALPVGLPLPSHVSLTGESDGGYMDMSKDESVDYVPMLDMKGDVKYADIESSNYMAPYDNYVPSAPERTCRATLINESPVLSYMDLVGFSYQVANGMEFLASKNCVHRDLAARNVLICEGKLVKICDFGLARDIMRDSNYISKGSTFLPLKWMAPESIFNSLYTTLSDVWSFGILLWEIFTLGGTPYPELPMNEQFYNAIKRGYRMAQPAHASDEIYEIMQKCWEEKFEIRPPFSQLVLLLERLLGEGYKKKYQQVDEEFLRSDHPAILRSQARLPGFHGLRSPLDTSSVLYTAVQPNEGDNDYIIPLPDPKPEVADEGPLEGSPSLASSTLNEVNTSSTISCDSPLEPQDEPEPEPQLELQVEPEPELEQLPDSGCPAPRAEAEDSFL

SEQ ID NO: 227 - protein, 22 aa, Homo sapiens
  misc_feature (1)..(22): Human PGFRB Intracellular Domain (E570tr)
QKKPRYEIRWKVIESVSSDGHE

SEQ ID NO: 228 - protein, 183 aa, Homo sapiens
  misc_feature (1)..(183): Human PGFRB Intracellular Domain (G739tr)
QKKPRYEIRWKVIESVSSDGHEFIFVDPMQLPYDSTWELPRDQLVLGRTLGSGAFGQVVEATAHGLSHSQATMKVAVAMLKSTARSSEKQALMSELKIMSHLGPHLNVVNLLGACTKGGPIYIITEYCRYGDLVDYLHRNKHTFLQHHSDKRRPPSAELYSNALPVGLPLPSHVSLTGESDGG

SEQ ID NO: 229 - protein, 26 aa, Artificial Sequence
  Synthetic: Linker
SGGGSGGGGSGGGGSGGGGSGGGSLQ

SEQ ID NO: 230 - protein, 14 aa, Artificial Sequence
  Synthetic: V5 tag
GKPIPNPLLGLDST

SEQ ID NO: 231 - protein, 5 aa, Artificial Sequence
  Synthetic: G4S Linker
GGGGS

SEQ ID NO: 232 - protein, 23 aa, Mus musculus
  misc_feature (1)..(23): Murine CD8 Transmembrane Domain
IYIWAPLAGICVALLLSLIITLI

SEQ ID NO: 233 - protein, 25 aa, Mus musculus
  misc_feature (1)..(25): Murine PDGFR Transmembrane domain
VVVISAILALVVLTVISLIILIMLW

SEQ ID NO: 234 - protein, 22 aa, Mus musculus
  misc_feature (1)..(22): Murine CD80 Transmembrane domain
TLVLFGAGFGAVITVVVIVVII

SEQ ID NO: 235 - protein, 32 aa, Mus musculus
  misc_feature (1)..(32): Murine CD80 intracellular domain
KCFCKHRSCFRRNEASRETNNSLTFGPEEALA

SEQ ID NO: 236 - DNA, 1869 bp, Artificial Sequence
  Synthetic: mIL12AB-80TM-ICD Nucleotide Sequence
atgtgtcctcagaagctaaccatctcctggtttgccatcgttttgttggtgtctccactcatggccatgtgggagctcgagaaagacgtttacgttgtagaggtggactggactcccgacgccccgggcgaaacagtgaacctcacctgtgacacgcctgaagaagatgacatcacctggacctcagaccagagacatggagtcataggctctggaaagaccctgaccatcactgtcaaagagttcctagatgctggccagtacacctgccacaaaggaggcgagactctgagccactcacatctgctgctccacaagaaggagaatggaatttggtccactgagatcctgaagaacttcaagaataagactttcctgaagtgtgaagcaccaaattactccggacggttcacgtgctcatggctggtgcaaagaaacatggacttgaagttcaacatcaagagcagtagcagttcccctgactctcgggcagtgacatgtggaatggcgtctctgtctgcagagaaggtcacactggaccaaagggactatgagaagtattcagtgtcctgccaggaggatgtcacctgcccaactgccgaggagacactgcccattgaactggcgttggaagcacggcagcagaataaatatgagaactacagcaccagcttcttcatcagggacatcatcaaaccagacccgcccaagaacttgcagatgaagcctttgaagaactcacaggtggaggtcagctgggagtacccggactcctggagcactccccattcctacttctccctcaagttctttgttcgaatccagcgcaagaaagagaagatgaaggagacagaggaggggtgtaaccagaaaggtgcgttcctcgtagagaagacatctaccgaagtccaatgcaaaggcgggaatgtctgcgtgcaagctcaggatcgctattacaattcctcatgcagcaagtgggcatgtgttccctgcagggtccgatccggaggcggagggagcggtggtggaggcagcggaggaggtggatcaagggtcattccagtctctggaccagctagatgtcttagccagtcccgaaacctgctgaagaccacggacgacatggtgaagacggccagagagaaactgaaacattattcctgcaccgcagaggatatcgatcacgaagatatcacacgggaccaaaccagcacattgaagacctgtttaccactggaactacacaagaacgagagttgcctggctactagagagacttcttccacaacaagagggagctgcctgccaccacagaagacgtctttgatgatgaccctgtgccttggtagcatctatgaggacctcaagatgtaccagacagagttccaggccatcaacgcagcacttcagaatcacaaccatcagcagatcattttagacaagggcatgctggtggccatcgatgagctgatgcaatcattgaatcataacggtgagacattgcgccagaaacctcctgtgggagaagcagacccttacagagtgaagatgaagctctgcatcctgcttcacgccttcagcacccgcgtcgtcactatcaacagggtgatgggctatctgagctccgccagcggtggcggaagcggtggaggcggcagcggcggtggtggtagcggcggcggcggctccggcggagggagcctgcagaccctggtgctgttcggcgccggcttcggtgcagtgatcaccgtggtggtgatcgtcgtcatcatcaagtgcttctgcaagcacagaagctgcttcagaagaaacgaggccagcagagaaaccaacaacagcctaacattcggcccagaagaggctctggcc

SEQ ID NO: 237 - protein, 623 aa, Artificial Sequence
  Synthetic: mIL12AB-80TM-ICD Amino Acid Sequence
MCPQKLTISWFAIVLLVSPLMAMWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRSGGGGSGGGGSGGGGSRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSASGGGSGGGGSGGGGSGGGGSGGGSLQTLVLFGAGFGAVITVVVIVVIIKCFCKHRSCFRRNEASRETNNSLTFGPEEALA

SEQ ID NO: 238 - DNA, 1818 bp, Artificial Sequence
  Synthetic: IgK-mscIL12AB-80TM-ICD Nucleotide
atggagactgacaccctgctgctgtgggtgctgttactttgggttcccggcagcaccggctacccctacgacgtgcccgactacgccatgtgggagctcgagaaagacgtttacgttgtagaggtggactggactcccgacgccccgggcgaaacagtgaacctcacctgtgacacgcctgaagaagatgacatcacctggacctcagaccagagacatggagtcataggctctggaaagaccctgaccatcactgtcaaagagttcctagatgctggccagtacacctgccacaaaggaggcgagactctgagccactcacatctgctgctccacaagaaggagaatggaatttggtccactgagatcctgaagaacttcaagaataagactttcctgaagtgtgaagcaccaaattactccggacggttcacgtgctcatggctggtgcaaagaaacatggacttgaagttcaacatcaagagcagtagcagttcccctgactctcgggcagtgacatgtggaatggcgtctctgtctgcagagaaggtcacactggaccaaagggactatgagaagtattcagtgtcctgccaggaggatgtcacctgcccaactgccgaggagacactgcccattgaactggcgttggaagcacggcagcagaataaatatgagaactacagcaccagcttcttcatcagggacatcatcaaaccagacccgcccaagaacttgcagatgaagcctttgaagaactcacaggtggaggtcagctgggagtacccggactcctggagcactccccattcctacttctccctcaagttctttgttcgaatccagcgcaagaaagagaagatgaaggagacagaggaggggtgtaaccagaaaggtgcgttcctcgtagagaagacatctaccgaagtccaatgcaaaggcgggaatgtctgcgtgcaagctcaggatcgctattacaattcctcatgcagcaagtgggcatgtgttccctgcagggtccgaggaagcaccagcggttccggcaaaccaggtagcggagagggcagcaccaagggcagggtcattccagtctctggaccagctagatgtcttagccagtcccgaaacctgctgaagaccacggacgacatggtgaagacggccagagagaaactgaaacattattcctgcaccgcagaggatatcgatcacgaagatatcacacgggaccaaaccagcacattgaagacctgtttaccactggaactacacaagaacgagagttgcctggctactagagagacttcttccacaacaagagggagctgcctgccaccacagaagacgtctttgatgatgaccctgtgccttggtagcatctatgaggacctcaagatgtaccagacagagttccaggccatcaacgcagcacttcagaatcacaaccatcagcagatcattttagacaagggcatgctggtggccatcgatgagctgatgcaatcattgaatcataacggtgagacattgcgccagaaacctcctgtgggagaagcagacccttacagagtgaagatgaagctctgcatcctgcttcacgccttcagcacccgcgtcgtcactatcaacagggtgatgggctatctgagctccgccaccctggtgctgttcggcgccggcttcggtgcagtgatcaccgtggtggtgatcgtcgtcatcatcaagtgcttttgcaagcacagaagctgtttcagaagaaacgaggccagcagagaaaccaacaactccctgactttcgggcccgaggaagccctcgcc

SEQ ID NO: 239 - protein, 606 aa, Artificial Sequence
  Synthetic: IgK-mscIL12AB-80TM-ICD Amino Acid
METDTLLLWVLLLWVPGSTGYPYDVPDYAMWELEKDVYVVEVDWTPDAPGETVNLTCDTPEEDDITWTSDQRHGVIGSGKTLTITVKEFLDAGQYTCHKGGETLSHSHLLLHKKENGIWSTEILKNFKNKTFLKCEAPNYSGRFTCSWLVQRNMDLKFNIKSSSSSPDSRAVTCGMASLSAEKVTLDQRDYEKYSVSCQEDVTCPTAEETLPIELALEARQQNKYENYSTSFFIRDIIKPDPPKNLQMKPLKNSQVEVSWEYPDSWSTPHSYFSLKFFVRIQRKKEKMKETEEGCNQKGAFLVEKTSTEVQCKGGNVCVQAQDRYYNSSCSKWACVPCRVRGSTSGSGKPGSGEGSTKGRVIPVSGPARCLSQSRNLLKTTDDMVKTAREKLKHYSCTAEDIDHEDITRDQTSTLKTCLPLELHKNESCLATRETSSTTRGSCLPPQKTSLMMTLCLGSIYEDLKMYQTEFQAINAALQNHNHQQIILDKGMLVAIDELMQSLNHNGETLRQKPPVGEADPYRVKMKLCILLHAFSTRVVTINRVMGYLSSATLVLFGAGFGAVITVVVIVVIIKCFCKHRSCFRRNEASRETNNSLTFGPEEALA

SEQ ID NO: 240 - DNA, 1791 bp, Artificial Sequence
  Synthetic: hIL12AB-8TM Nucleotide Sequence
atgtgccaccagcagctggtgatcagctggttcagcctggtgttcctggccagccccctggtggccatctgggagctgaagaaggacgtgtacgtggtggagttggattggtaccccgacgcccccggcgagatggtggtgctgacctgcgacacccccgaggaggacggcatcacctggaccctggaccagagcagcgaggtgctgggcagcggcaagaccctgaccatccaggtgaaggagttcggcgacgccggccagtacacctgccacaagggcggcgaggtgctgagccacagcctgctgctgctgcacaagaaggaggacggcatctggagcaccgacatcctgaaggaccagaaggagcccaagaacaagaccttcctgagatgcgaggccaagaactacagcggcagattcacctgctggtggctgaccaccatcagcaccgacctgaccttcagcgtgaagagcagcagaggcagcagcgacccccagggcgtgacctgcggcgccgccaccctgagcgccgagagagtgagaggcgacaacaaggagtacgagtacagcgtggagtgccaggaagatagcgcctgccccgccgccgaggagagcctgcccatcgaggtgatggtggacgccgtgcacaagctgaagtacgagaactacaccagcagcttcttcatcagagatatcatcaagcccgacccccccaagaacctgcagctgaagcccctgaagaacagccggcaggtggaggtgagctgggagtaccccgacacctggagcaccccccacagctacttcagcctgaccttctgcgtgcaggtgcagggcaagagcaagagagagaagaaagatagagtgttcaccgacaagaccagcgccaccgtgatctgcagaaagaacgccagcatcagcgtgagagcccaagatagatactacagcagcagctggagcgagtgggccagcgtgccctgcagcggcggcggcggcggcggcagcagaaacctgcccgtggccacccccgaccccggcatgttcccctgcctgcaccacagccagaacctgctgagagccgtgagcaacatgctgcagaaggcccggcagaccctggagttctacccctgcaccagcgaggagatcgaccacgaagatatcaccaaagataagaccagcaccgtggaggcctgcctgcccctggagctgaccaagaacgagagctgcctgaacagcagagagaccagcttcatcaccaacggcagctgcctggccagcagaaagaccagcttcatgatggccctgtgcctgagcagcatctacgaggacctgaagatgtaccaggtggagttcaagaccatgaacgccaagctgctgatggaccccaagcggcagatcttcctggaccagaacatgctggccgtgatcgacgagctgatgcaggccctgaacttcaacagcgagaccgtgccccagaagagcagcctggaggagcccgacttctacaagaccaagatcaagctgtgcatcctgctgcacgccttcagaatcagagccgtgaccatcgacagagtgatgagctacctgaacgccagctctggtggcggatcaggcggcggcggttcaggaggcggtggaagtggaggtggcgggtctggcggaggttcactgcagatctacatctgggctccactggccggcacctgcggcgtgctgctgctgagcctggtgatcaccctgtactgctacgggaaaccaattccaaatcccctcctggggttggatagcacc

SEQ ID NO: 241 - protein, 597 aa, Artificial Sequence
  Synthetic: hIL12AB-8TM Amino Acid Sequence
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASSGGGSGGGGSGGGGSGGGGSGGGSLQIYIWAPLAGTCGVLLLSLVITLYCYGKPIPNPLLGLDST

SEQ ID NO: 242 - DNA, 1749 bp, Artificial Sequence
  Synthetic: hIL12AB-8TM no epitope tag Nucleotide Sequence
atgtgccaccagcagctggtgatcagctggttcagcctggtgttcctggccagccccctggtggccatctgggagctgaagaaggacgtgtacgtggtggagttggattggtaccccgacgcccccggcgagatggtggtgctgacctgcgacacccccgaggaggacggcatcacctggaccctggaccagagcagcgaggtgctgggcagcggcaagaccctgaccatccaggtgaaggagttcggcgacgccggccagtacacctgccacaagggcggcgaggtgctgagccacagcctgctgctgctgcacaagaaggaggacggcatctggagcaccgacatcctgaaggaccagaaggagcccaagaacaagaccttcctgagatgcgaggccaagaactacagcggcagattcacctgctggtggctgaccaccatcagcaccgacctgaccttcagcgtgaagagcagcagaggcagcagcgacccccagggcgtgacctgcggcgccgccaccctgagcgccgagagagtgagaggcgacaacaaggagtacgagtacagcgtggagtgccaggaagatagcgcctgccccgccgccgaggagagcctgcccatcgaggtgatggtggacgccgtgcacaagctgaagtacgagaactacaccagcagcttcttcatcagagatatcatcaagcccgacccccccaagaacctgcagctgaagcccctgaagaacagccggcaggtggaggtgagctgggagtaccccgacacctggagcaccccccacagctacttcagcctgaccttctgcgtgcaggtgcagggcaagagcaagagagagaagaaagatagagtgttcaccgacaagaccagcgccaccgtgatctgcagaaagaacgccagcatcagcgtgagagcccaagatagatactacagcagcagctggagcgagtgggccagcgtgccctgcagcggcggcggcggcggcggcagcagaaacctgcccgtggccacccccgaccccggcatgttcccctgcctgcaccacagccagaacctgctgagagccgtgagcaacatgctgcagaaggcccggcagaccctggagttctacccctgcaccagcgaggagatcgaccacgaagatatcaccaaagataagaccagcaccgtggaggcctgcctgcccctggagctgaccaagaacgagagctgcctgaacagcagagagaccagcttcatcaccaacggcagctgcctggccagcagaaagaccagcttcatgatggccctgtgcctgagcagcatctacgaggacctgaagatgtaccaggtggagttcaagaccatgaacgccaagctgctgatggaccccaagcggcagatcttcctggaccagaacatgctggccgtgatcgacgagctgatgcaggccctgaacttcaacagcgagaccgtgccccagaagagcagcctggaggagcccgacttctacaagaccaagatcaagctgtgcatcctgctgcacgccttcagaatcagagccgtgaccatcgacagagtgatgagctacctgaacgccagctctggtggcggatcaggcggcggcggttcaggaggcggtggaagtggaggtggcgggtctggcggaggttcactgcagatctacatctgggctccactggccggcacctgcggcgtgctgctgctgagcctggtgatcaccctgtactgctac

SEQ ID NO: 243 - protein, 583 aa, Artificial Sequence
  Synthetic: hIL12AB-8TM no epitope tag Amino Acid Sequence
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASSGGGSGGGGSGGGGSGGGGSGGGSLQIYIWAPLAGTCGVLLLSLVITLYCY

SEQ ID NO: 244 - DNA, 1812 bp, Artificial Sequence
  Synthetic: h12AB-80TID Nucleotide Sequence 1 matched
atgtgccaccagcagctggtgatcagctggttcagcctggtgttcctggccagccccctggtggccatctgggagctgaagaaggacgtgtacgtggtggagttggattggtaccccgacgcccccggcgagatggtggtgctgacctgcgacacccccgaggaggacggcatcacctggaccctggaccagagcagcgaggtgctgggcagcggcaagaccctgaccatccaggtgaaggagttcggcgacgccggccagtacacctgccacaagggcggcgaggtgctgagccacagcctgctgctgctgcacaagaaggaggacggcatctggagcaccgacatcctgaaggaccagaaggagcccaagaacaagaccttcctgagatgcgaggccaagaactacagcggcagattcacctgctggtggctgaccaccatcagcaccgacctgaccttcagcgtgaagagcagcagaggcagcagcgacccccagggcgtgacctgcggcgccgccaccctgagcgccgagagagtgagaggcgacaacaaggagtacgagtacagcgtggagtgccaggaagatagcgcctgccccgccgccgaggagagcctgcccatcgaggtgatggtggacgccgtgcacaagctgaagtacgagaactacaccagcagcttcttcatcagagatatcatcaagcccgacccccccaagaacctgcagctgaagcccctgaagaacagccggcaggtggaggtgagctgggagtaccccgacacctggagcaccccccacagctacttcagcctgaccttctgcgtgcaggtgcagggcaagagcaagagagagaagaaagatagagtgttcaccgacaagaccagcgccaccgtgatctgcagaaagaacgccagcatcagcgtgagagcccaagatagatactacagcagcagctggagcgagtgggccagcgtgccctgcagcggcggcggcggcggcggcagcagaaacctgcccgtggccacccccgaccccggcatgttcccctgcctgcaccacagccagaacctgctgagagccgtgagcaacatgctgcagaaggcccggcagaccctggagttctacccctgcaccagcgaggagatcgaccacgaagatatcaccaaagataagaccagcaccgtggaggcctgcctgcccctggagctgaccaagaacgagagctgcctgaacagcagagagaccagcttcatcaccaacggcagctgcctggccagcagaaagaccagcttcatgatggccctgtgcctgagcagcatctacgaggacctgaagatgtaccaggtggagttcaagaccatgaacgccaagctgctgatggaccccaagcggcagatcttcctggaccagaacatgctggccgtgatcgacgagctgatgcaggccctgaacttcaacagcgagaccgtgccccagaagagcagcctggaggagcccgacttctacaagaccaagatcaagctgtgcatcctgctgcacgccttcagaatcagagccgtgaccatcgacagagtgatgagctacctgaacgccagctctggtggcggatcaggcggcggcggttcaggaggcggtggaagtggaggtggcgggtctggcggaggttcactgcagctgctgcccagctgggccatcaccctgatcagcgtgaacggcatcttcgtgatctgctgcctgacctactgcttcgcccctcgatgcagagagagaagaagaaacgagagactgagaagagagagcgtgcgacccgtg

SEQ ID NO: 245 - DNA, 1812 bp, Artificial Sequence
  Synthetic: h12AB-80TID Nucleotide Sequence 2 SE_IL12_041
atgtgccaccagcagctggtgatcagctggttcagcctggtgttcctggccagccctctggtggccatctgggagctgaagaaggacgtgtacgtggtggagctggactggtaccctgacgcccctggcgagatggtggtgctgacctgcgacacccctgaggaggacggcatcacctggaccctggaccagagcagcgaggtgctgggcagcggcaagaccctgaccatccaggtgaaggagttcggcgacgccggccagtacacctgccacaagggcggagaggtgttaagccacagcctgctcttgctacacaagaaggaggacggtatttggagcaccgacatcctgaaggaccagaaggagcctaagaacaagaccttcctgaggtgcgaggccaagaactacagcggcagattcacctgctggtggctgaccaccatctccacggacctgaccttcagcgttaagagtagcagaggcagcagcgaccctcagggcgtgacttgtggcgccgccaccctgagcgccgagagagtgagaggcgacaacaaggagtacgagtacagcgtggagtgccaggaggacagcgcctgccctgccgccgaggagagcctgcctatcgaggtgatggtggacgccgtgcacaagctgaagtacgagaattacacctcatccttcttcatcagagacatcatcaagcctgaccctccaaagaatctgcagctgaagcctctgaagaacagcagacaggtggaggtgagctgggagtatccggatacctggagcacacctcacagctacttctcacttacattctgcgtgcaggtgcagggcaagagcaagagagagaagaaggatagagtgttcaccgacaagaccagcgccaccgtgatctgcagaaagaacgccagcatctcagtgagagcccaggacagatactactcatcctcctggagcgagtgggccagcgtgccttgctccggtggtggtggcggaggcagcagaaacctgcctgtggctacacctgatcctggcatgttcccttgcctgcaccacagccagaacctgctgagagccgtgagcaacatgctgcagaaggccagacagactctggagttctacccttgcaccagcgaggagatcgaccacgaggacatcaccaaggataagacaagcaccgtggaggcctgcctgcctctggagctgaccaagaacgagagctgcctaaactctagggaaaccagcttcattactaacggcagttgcttagccagccggaagacatcgttcatgatggccctgtgcctgagcagcatctacgaggacctgaagatgtaccaagtggagttcaagaccatgaacgccaagctgctgatggaccctaagagacagatcttcctagaccagaacatgctcgccgtgatcgacgagctgatgcaggccctgaacttcaacagcgaaactgtgcctcagaagagttcactggaggagcctgacttctataagactaagatcaagctgtgtattctcctccacgccttcagaatcagggctgtcaccatcgatagggtgatgagctacctgaacgcatcgtccggcggaggatccggaggaggaggctccggcggtggtggaagtggaggaggtggatcaggaggcggtagtctccagctcctgcctagctgggccatcaccctgatctctgtaaacggcattttcgtcatttgctgtctgacttactgcttcgcccctaggtgccgggagcgtaggagaaacgagagactgcgccgggagtccgtgcggcctgtg

SEQ ID NO: 246 - DNA, 1812 bp, Artificial Sequence
  Synthetic: h12AB-80TID Nucleotide Sequence 3 SE_IL12_042
atgtgtcaccagcagctcgtgatcagctggttcagcctggtgttcctggcctccccgctggtggccatctgggagctgaagaaggacgtgtacgtggtggagctggactggtaccccgacgctcccggcgagatggtggtgctgacctgcgacacaccggaggaagacggaatcacctggaccctggaccaatcctccgaagttctgggcagcggcaagaccctgaccatccaggtgaaggagttcggcgacgccggccagtacacctgccacaagggcggcgaggtgctgagccacagcctgctcctcctccacaagaaagaggacggcatctggagcaccgacatcctgaaggaccagaaggagcccaagaacaagaccttcctgcggtgcgaggccaagaactactcaggccgattcacctgttggtggctcacaactatcagcacagacctgaccttcagcgtgaagtctagccggggcagcagcgatcctcagggcgtgacctgcggcgccgccaccctgagcgccgagcgggtgcggggcgacaacaaggagtacgagtacagcgtggagtgccaggaggacagcgcctgcccggccgccgaagagtccctgcccatcgaggtgatggtggacgccgtgcacaaactcaagtacgagaactacacctccagcttcttcatccgggacatcatcaagcccgatccgcccaagaacctgcagctgaagcccctgaagaacagccggcaggtggaggtgagctgggaatacccggacacgtggtccaccccacacagctacttcagcctgaccttttgcgtgcaggtccaaggcaagagcaagcgggagaagaaggaccgggtgttcaccgataagacctcagccaccgtgatttgcagaaagaacgcatccatatccgtacgcgcccaggatcggtactacagcagcagctggagcgagtgggccagcgtgccctgtagcggcggcggcggtggtgggagtcgcaacctgcccgtggccaccccggaccccggcatgttcccctgcctgcaccacagccagaacctgctgcgggccgtgagcaacatgctgcagaaggcccggcagaccctggagttctacccctgcaccagcgaggagatcgaccacgaggacatcaccaaggacaagaccagcaccgtggaggcctgcctgcccctggagctgaccaagaacgagagctgcctgaacagtcgcgaaacctccttcattacgaacggcagctgcctggccagccggaagaccagcttcatgatggccctgtgcctgagcagcatctacgaggacctgaagatgtaccaggtggagttcaagaccatgaacgccaagctgctgatggaccccaagcggcagatcttcctggaccagaacatgctggccgtgatcgacgagctgatgcaggccctgaacttcaacagcgaaaccgtgccccagaagtccagcctggaggagcccgacttctacaagaccaagatcaagctgtgcatcctgctgcacgccttccggatccgggccgtgaccatcgaccgggtgatgagctacctgaacgcctcttccggtggcgggagcggaggcggtggatctggcggaggagggtcgggaggcggcggaagcggtggtggaagccttcaactgctgccctcgtgggccatcacactgatctccgtgaacggcatcttcgtgatctgctgcctgacctactgcttcgcccctcggtgccgcgagcgacggagaaacgagaggctcagacgggagagcgtgcggcccgtg

SEQ ID NO: 247 - DNA, 1812 bp, Artificial Sequence
  Synthetic: h12AB-80TID Nucleotide Sequence 4 SE_IL12_043
atgtgccaccaacagctggtgatcagctggttcagcctggtgttcctggcctcacccctggtggccatctgggagctgaagaaggacgtgtacgtggtggagctggactggtaccccgacgcccctggcgagatggtggtgctgacctgcgacacgcccgaggaagacggtatcacctggactctggaccagagcagcgaggtgctgggcagcggcaagaccctgaccatccaggtgaaggagttcggcgacgccggccagtacacctgccacaagggcggcgaagtgctgagccacagccttctgctgctgcacaagaaggaggacggcatttggagcaccgacatcctgaaggaccagaaggagcccaagaacaagaccttcctgcggtgcgaggccaagaactacagcggccggttcacctgctggtggctgaccaccatcagcaccgaccttaccttcagcgttaagagcagccggggcagcagcgatccccagggcgtgacctgcggagccgccaccctctccgcagagcgggtgcgtggcgacaacaaggagtacgagtacagcgtggagtgccaggaggatagcgcctgtcccgctgccgaagagagcctgcccatcgaggtgatggtggacgccgtgcacaagctgaagtacgagaactacaccagcagcttcttcatccgggacatcatcaagcccgatccacccaagaacctgcagctgaagcccctgaagaacagcaggcaggttgaggtgagctgggaataccccgacacctggagcacccctcacagctacttcagcctgaccttctgcgtgcaggtgcagggcaagagcaagcgggagaagaaggatcgggtgttcaccgataagaccagcgccaccgtgatctgccggaagaacgccagcatcagcgttcgggcccaggaccggtactacagcagcagctggagcgagtgggccagcgtgccctgctctggaggcggaggcggaggctcacggaacctgccagtggccacgccggatcccggcatgttcccctgcctgcaccacagccagaacctgctgcgggccgtgagcaacatgctgcagaaggcccggcagaccctggagttctacccctgcaccagcgaggagatcgaccacgaggacatcaccaaggacaagaccagcaccgtggaggcctgcctgcccctggagctgaccaagaacgagagctgcctgaacagccgggagacaagcttcatcaccaacggcagctgcctggccagccggaagaccagcttcatgatggccctgtgcctgagcagcatctacgaggacctgaagatgtaccaggtggagttcaagaccatgaacgccaagctgctgatggaccccaagcggcagatcttcctggatcagaacatgctggccgtgatcgacgagctgatgcaggccctgaacttcaacagcgagactgtgccccagaagtccagcctggaggagcccgacttctacaagaccaagatcaagctgtgcatcctgctgcacgccttccggatccgggctgtgaccatcgaccgggtgatgagctacctgaacgcctcttccggcggcggatcgggaggtggaggttctggaggaggtggaagcggtggtggcggaagcggcggtggcagcctgcaattgctccccagctgggccatcaccctgatcagcgtgaacggcatcttcgtgatctgttgcctgacctactgcttcgccccacggtgccgggagagacggcggaacgagcggctgcggcgagagagcgtgcggcccgtg

SEQ ID NO: 248 - DNA, 1812 bp, Artificial Sequence
  Synthetic: h12AB-80TID Nucleotide Sequence 5 SE_IL12_044
atgtgtcaccagcagttggtgatatcttggttctcactggtgtttcttgcatcaccactcgtggcgatctgggaacttaagaaggacgtctacgtggtggagttagattggtatcctgacgcacccggggaaatggttgtcctcacgtgcgacactccagaggaagacgggatcacctggaccctggatcagtcgtcagaggtacttggcagtggcaagacactgacaatccaggttaaagagtttggtgacgccgggcagtatacgtgccacaagggcggcgaggtgttgtcacattctctgcttctcctgcacaagaaagaagacggcatctggtcaactgacatcctgaaagaccagaaagaacccaagaataagaccttcctccgttgcgaagcaaagaactactcagggcgtttcacttgctggtggctaaccacaatttctaccgatctgacgttctctgtgaagtcaagtaggggatcctcagaccctcaaggggtcacctgcggcgccgccaccttatccgccgaaagagttcggggtgacaataaagagtacgagtacagcgtcgagtgtcaggaggactccgcctgtcctgctgcagaggagtccctgccgatcgaagttatggtggacgccgtccacaagctcaaatacgagaactacacctcaagcttcttcatcagagacatcatcaagcctgatccacccaagaacctgcaactgaagcctttgaagaacagccgacaggtggaggtttcttgggaatatccagacacgtggagtacgccccattcctacttcagcttgaccttctgcgtgcaggttcaggggaagtccaagagagagaagaaggatcgtgtgttcacagacaagacctccgccaccgtgatctgccggaagaacgcatctatcagtgttagggcccaggatcggtactactcgagttcctggtctgagtgggcaagtgtgccctgctccggtggcggcggaggagggtcaaggaacctgcccgttgccacaccagatccaggaatgttcccctgtctgcaccactctcagaaccttttgcgagccgtttctaatatgcttcagaaggctcggcagacccttgagttttatccctgcacgtctgaggagatcgatcacgaggacatcaccaaggacaagacttccaccgttgaagcctgtttacctctggaactgaccaagaacgaatcctgtctcaacagtagggaaacgagcttcatcactaacggaagctgtctggctagccggaagacctcttttatgatggccctgtgcttgagctctatttacgaagatttgaagatgtaccaagtggaatttaagactatgaacgccaaactgctgatggaccctaagcgccaaatcttcttggatcagaatatgctggctgtaatcgacgagctcatgcaggctctgaacttcaacagcgagacggtaccgcagaagagttccctggaagaaccggacttctacaagactaagattaaactctgcatactcctccacgccttccggatcagggccgtcacaatagatagggtcatgagttatcttaacgcgagttctggtggtggatcgggtggcggaggctcaggaggaggcggttctggcggtggtgggagtggaggcggtagtctgcagctgctgccgagttgggcaatcacgctaatcagcgtgaacggaatattcgtaatttgttgcctcacctattgtttcgcacccaggtgcagggaaaggaggcgaaacgaaaggttgaggagggaatctgtccggccagtg

SEQ ID NO: 249 - protein, 604 aa, Artificial Sequence
  Synthetic: h12AB-80TID Amino Acid Sequence  1 (Corresponds to nucleotide sequences 1-5)
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASSGGGSGGGGSGGGGSGGGGSGGGSLQLLPSWAITLISVNGIFVICCLTYCFAPRCRERRRNERLRRESVRPV

SEQ ID NO: 250 - RNA, 75 nt, Homo sapiens
  misc_feature (1)..(75): Human PGFRB transmembrane domain nucleotide sequence
gugguggugaucagcgccauccuggcccugguggugcugaccaucaucagccugaucauccugaucaugcugugg

SEQ ID NO: 251 - RNA, 66 nt, Homo sapiens
  misc_feature (1)..(66): Human PGFRB E570tr intracellular domain nucleotide sequence
cagaagaagcccagauacgagaucagauggaaggugaucgagagcgugagcagcgacggccacgag

SEQ ID NO: 252 - DNA, 2298 bp, Artificial Sequence
  Synthetic: h12AB-PTM-ICD-E570tr Nucleotide Sequence
atgtgccaccagcagctggtgatcagctggttcagcctggtgttcctggccagccccctggtggccatctgggagctgaagaaggacgtgtacgtggtggagttggattggtaccccgacgcccccggcgagatggtggtgctgacctgcgacacccccgaggaggacggcatcacctggaccctggaccagagcagcgaggtgctgggcagcggcaagaccctgaccatccaggtgaaggagttcggcgacgccggccagtacacctgccacaagggcggcgaggtgctgagccacagcctgctgctgctgcacaagaaggaggacggcatctggagcaccgacatcctgaaggaccagaaggagcccaagaacaagaccttcctgagatgcgaggccaagaactacagcggcagattcacctgctggtggctgaccaccatcagcaccgacctgaccttcagcgtgaagagcagcagaggcagcagcgacccccagggcgtgacctgcggcgccgccaccctgagcgccgagagagtgagaggcgacaacaaggagtacgagtacagcgtggagtgccaggaagatagcgcctgccccgccgccgaggagagcctgcccatcgaggtgatggtggacgccgtgcacaagctgaagtacgagaactacaccagcagcttcttcatcagagatatcatcaagcccgacccccccaagaacctgcagctgaagcccctgaagaacagccggcaggtggaggtgagctgggagtaccccgacacctggagcaccccccacagctacttcagcctgaccttctgcgtgcaggtgcagggcaagagcaagagagagaagaaagatagagtgttcaccgacaagaccagcgccaccgtgatctgcagaaagaacgccagcatcagcgtgagagcccaagatagatactacagcagcagctggagcgagtgggccagcgtgccctgcagcggcggcggcggcggcggcagcagaaacctgcccgtggccacccccgaccccggcatgttcccctgcctgcaccacagccagaacctgctgagagccgtgagcaacatgctgcagaaggcccggcagaccctggagttctacccctgcaccagcgaggagatcgaccacgaagatatcaccaaagataagaccagcaccgtggaggcctgcctgcccctggagctgaccaagaacgagagctgcctgaacagcagagagaccagcttcatcaccaacggcagctgcctggccagcagaaagaccagcttcatgatggccctgtgcctgagcagcatctacgaggacctgaagatgtaccaggtggagttcaagaccatgaacgccaagctgctgatggaccccaagcggcagatcttcctggaccagaacatgctggccgtgatcgacgagctgatgcaggccctgaacttcaacagcgagaccgtgccccagaagagcagcctggaggagcccgacttctacaagaccaagatcaagctgtgcatcctgctgcacgccttcagaatcagagccgtgaccatcgacagagtgatgagctacctgaacgccagctctggtggcggatcaggcggcggcggttcaggaggcggtggaagtggaggtggcgggtctggcggaggttcactgcaggtggtggtgatcagcgccatcctggccctggtggtgctcaccatcatcagcctgatcatcctgatcatgctgtggcagaagaagcccagatacgagatccggtggaaggtgatcgagagcgtgagcagcgacggccacgagttcatcttcgtggaccccatgcagctgccctacgacagcacctgggagctgccccgtgatcagctggtgctgggcagaaccctgggcagcggcgccttcggccaggtggtggaggctaccgcccacggcctgagccacagccaggccaccatgaaggtggccgtggccatgctcaagagcaccgccagaagcagcgagaagcaggccctgatgagcgagctgaagatcatgagccatctggggccccacctgaacgtggtgaacctgctgggcgcctgcaccaagggcggccccatctacatcatcaccgagtactgcagatacggcgacctggtggactacctgcacagaaacaagcacaccttcctgcagcaccacagcgacaagagaagacctcccagcgccgagctgtacagcaacgccctgcccgttggtctgcccctacccagccacgtgagcctgaccggcgagagcgacggcggc

SEQ ID NO: 253 - protein, 605 aa, Artificial Sequence
  Synthetic: h12AB-PTM-ICD-E570tr Amino Acid Sequence
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASSGGGSGGGGSGGGGSGGGGSGGGSLQVVVISAILALVVLTIISLIILIMLWQKKPRYEIRWKVIESVSSDGHE

SEQ ID NO: 254 - DNA, 2298 bp, Artificial Sequence; identical to SEQ ID NO: 252
  Synthetic: h12AB-PTM-ICD-G739tr Nucleotide Sequence

SEQ ID NO: 255 - protein, 766 aa, Artificial Sequence
  Synthetic: h12AB-PTM-ICD-G739tr Amino Acid Sequence
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASSGGGSGGGGSGGGGSGGGGSGGGSLQVVVISAILALVVLTIISLIILIMLWQKKPRYEIRWKVIESVSSDGHEFIFVDPMQLPYDSTWELPRDQLVLGRTLGSGAFGQVVEATAHGLSHSQATMKVAVAMLKSTARSSEKQALMSELKIMSHLGPHLNVVNLLGACTKGGPIYIITEYCRYGDLVDYLHRNKHTFLQHHSDKRRPPSAELYSNALPVGLPLPSHVSLTGESDGG

SEQ ID NO: 256 - RNA, 12 nt, Artificial Sequence
  Synthetic: [CCG]4
ccgccgccgccg

SEQ ID NO: 257 - RNA, 15 nt, Artificial Sequence
  Synthetic: [CCG]5
ccgccgccgccgccg

SEQ ID NO: 258 - RNA, 10 nt, Artificial Sequence
  Synthetic: V1 GC-rich RNA element
ccccggcgcc

SEQ ID NO: 259 - RNA, 7 nt, Artificial Sequence
  Synthetic: V2 GC-rich RNA element
ccccggc

SEQ ID NO: 260 - RNA, 6 nt, Artificial Sequence
  Synthetic: EK GC-rich RNA element
gccgcc

SEQ ID NO: 261 - DNA, 41 bp, Artificial Sequence
  Synthetic: 5UTR
gggaaataagagagaaaagaagagtaagaagaaatataaga

SEQ ID NO: 262 - DNA, 57 bp, Artificial Sequence
  Synthetic: V1 - 5 UTR
gggaaataagagagaaaagaagagtaagaagaaatataagaccccggcgccgccacc

SEQ ID NO: 263 - DNA, 54 bp, Artificial Sequence
  Synthetic: V2 - 5UTR
gggaaataagagagaaaagaagagtaagaagaaatataagaccccggcgccacc

SEQ ID NO: 264 - DNA, 47 bp, Artificial Sequence
  Synthetic: Standard 5UTR
gggaaataagagagaaaagaagagtaagaagaaatataagagccacc

SEQ ID NO: 265 - RNA, 6 nt, Artificial Sequence
  Synthetic: Kozak consensus
gccrcc

SEQ ID NO: 266 - DNA, 141 bp, Artificial Sequence
  Synthetic: 3UTR with mir-122-5p binding site
tgataataggctggagcctcggtggcctagcttcttgccccttgggcctccccccagcccctcctccccttcctgcacccgtaccccccaaacaccattgtcacactccagtggtctttgaataaagtctgagtgggcggc

SEQ ID NO: 267 - RNA, 1817 nt, Artificial Sequence
  Synthetic: mIL12AB-04-001
gggaaauaagagagaaaagaagaguaagaagaaauauaagagccaccauguguccucagaagcuaaccaucuccugguuugccaucguuuugcuggugucuccacucauggccaugugggagcuggagaaagacguuuauguuguagagguggacuggacucccgaugccccuggagaaacagugaaccucaccugugacacgccugaagaagaugacaucaccuggaccucagaccagagacauggagucauaggcucuggaaagacccugaccaucacugucaaagaguuccuagaugcuggccaguacaccugccacaaaggaggcgagacucugagccacucacaucugcugcuccacaagaaggaaaauggaauuugguccacugaaauuuuaaaaaauuucaaaaacaagacuuuccugaagugugaagcaccaaauuacuccggacgguucacgugcucauggcuggugcaaagaaacauggacuugaaguucaacaucaagagcaguagcaguuccccugacucucgggcagugacauguggaauggcgucucugucugcagagaaggucacacuggaccaaagggacuaugagaaguauucaguguccugccaggaggaugucaccugcccaacugccgaggagacccugcccauugaacuggcguuggaagcacggcagcagaauaaauaugagaacuacagcaccagcuucuucaucagggacaucaucaaaccagacccgcccaagaacuugcagaugaagccuuugaagaacucacagguggaggucagcugggaguacccugacuccuggagcacuccccauuccuacuucucccucaaguucuuuguucgaauccagcgcaagaaagaaaagaugaaggagacagaggagggguguaaccagaaaggugcguuccucguagagaagacaucuaccgaaguccaaugcaaaggcgggaaugucugcgugcaagcucaggaucgcuauuacaauuccucaugcagcaagugggcauguguucccugcaggguccgauccggaggcggagggagcggaggcggagggagcggaggcggagggagcagggucauuccagucucuggaccugccaggugucuuagccagucccgaaaccugcugaagaccacagaugacauggugaagacggccagagaaaaacugaaacauuauuccugcacugcugaagacaucgaucaugaagacaucacacgggaccaaaccagcacauugaagaccuguuuaccacuggaacuacacaagaacgagaguugccuggcuacuagagagacuucuuccacaacaagagggagcugccugcccccacagaagacgucuuugaugaugacccugugccuugguagcaucuaugaggacuugaagauguaccagacagaguuccaggccaucaacgcagcacuucagaaucacaaccaucagcagaucauuuuagacaagggcaugcugguggccaucgaugagcugaugcagucucugaaucauaauggcgagacucugcgccagaaaccuccugugggagaagcagacccuuacagagugaaaaugaagcucugcauccugcuucacgccuucagcacccgcgucgugaccaucaacagggugaugggcuaucugagcuccgccugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 268 - RNA, 1737 nt, Artificial Sequence
  Synthetic: mIL12AB 80TM- nolinker_ V5_  Nucleotide Sequence
auguguccucagaagcuaaccaucuccugguuugccaucguuuuguuggugucuccacucauggccaugugggagcucgagaaagacguuuacguuguagagguggacuggacucccgacgccccgggcgaaacagugaaccucaccugugacacgccugaagaagaugacaucaccuggaccucagaccagagacauggagucauaggcucuggaaagacccugaccaucacugucaaagaguuccuagaugcuggccaguacaccugccacaaaggaggcgagacucugagccacucacaucugcugcuccacaagaaggagaauggaauuugguccacugagauccugaagaacuucaagaauaagacuuuccugaagugugaagcaccaaauuacuccggacgguucacgugcucauggcuggugcaaagaaacauggacuugaaguucaacaucaagagcaguagcaguuccccugacucucgggcagugacauguggaauggcgucucugucugcagagaaggucacacuggaccaaagggacuaugagaaguauucaguguccugccaggaggaugucaccugcccaacugccgaggagacacugcccauugaacuggcguuggaagcacggcagcagaauaaauaugagaacuacagcaccagcuucuucaucagggacaucaucaaaccagacccgcccaagaacuugcagaugaagccuuugaagaacucacagguggaggucagcugggaguacccggacuccuggagcacuccccauuccuacuucucccucaaguucuuuguucgaauccagcgcaagaaagagaagaugaaggagacagaggagggguguaaccagaaaggugcguuccucguagagaagacaucuaccgaaguccaaugcaaaggcgggaaugucugcgugcaagcucaggaucgcuauuacaauuccucaugcagcaagugggcauguguucccugcaggguccgauccggaggcggagggagcggugguggaggcagcggaggagguggaucaagggucauuccagucucuggaccagcuagaugucuuagccagucccgaaaccugcugaagaccacggacgacauggugaagacggccagagagaaacugaaacauuauuccugcaccgcagaggauaucgaucacgaagauaucacacgggaccaaaccagcacauugaagaccuguuuaccacuggaacuacacaagaacgagaguugccuggcuacuagagagacuucuuccacaacaagagggagcugccugccaccacagaagacgucuuugaugaugacccugugccuugguagcaucuaugaggaccucaagauguaccagacagaguuccaggccaucaacgcagcacuucagaaucacaaccaucagcagaucauuuuagacaagggcaugcugguggccaucgaugagcugaugcaaucauugaaucauaacggugagacauugcgccagaaaccuccugugggagaagcagacccuuacagagugaagaugaagcucugcauccugcuucacgccuucagcacccgcgucgucacuaucaacagggugaugggcuaucugagcuccgccacccuggugcuguucggcgccggcuucggugcagugaucaccgugguggugaucgucgucaucaucgggaaaccaauuccaaauccccuccugggguuggauagcacc

SEQ ID NO: 269 - RNA, 1839 nt, Artificial Sequence
  Synthetic: mIL12AB-PTM_v5 miR122 Nucleotide Sequence
auguguccucagaagcuaaccaucuccugguuugccaucguuuugcuugugucuccacucauggccaugugggagcucgagaaagacguuuacguuguagagguggacuggacucccgacgccccaggagaaacagugaaccucaccugugacacgccugaagaagaugacaucaccuggaccucagaccagagacauggagucauaggcucuggaaagacccugaccaucacugucaaagaguuccuagaugcuggccaguacaccugccacaaaggaggcgagacucugagccacucacaucugcugcuccacaagaaggagaauggaauuugguccaccgaaauccugaagaacuucaagaauaagacuuuccugaagugugaagcaccaaauuacuccggacgguucacgugcucauggcuggugcaaagaaacauggacuugaaguucaacaucaagagcaguagcaguuccccugacucucgggcagugacauguggaauggcgucucugucugcagagaaggucacacuggaccaaagggacuaugagaaguauucaguguccugccaggaggaugucaccugcccaacugccgaggaaacucugcccauugaacuggcguuggaagcacggcagcagaauaaauaugagaacuacagcaccagcuucuucaucagggacaucaucaaaccagacccgcccaagaacuugcagaugaagccuuugaagaacucacagguggaggucagcugggaguacccagacuccuggagcacuccccauuccuacuucucccucaaguucuuuguucgaauccagcgcaagaaagagaagaugaaggagacagaggagggguguaaccagaaaggugcguuccucguagagaagacaucuaccgaaguccaaugcaaaggcgggaaugucugcgugcaagcucaggaucgcuauuacaauuccucaugcagcaagugggcauguguucccugcaggguccgauccggaggcggagggucuggaggaggagguucuggaggugguggcaguagggucauuccagucucuggaccugcaaggugucuuagccagucccgaaaccugcugaagaccacagacgauauggugaagacggccagagagaaacugaaacauuauuccugcacagcagaggacaucgaucaugaagauauuacacgggaccaaaccagcacauugaagaccuguuuaccacuggaacuacacaagaacgagaguugccuggcuacuagagagacuucuuccacaacaagagggagcugccugccaccacagaagacgucuuugaugaugacccugugccuugguagcaucuacgaggaucucaagauguaccagacagaguuccaggccaucaacgcagcacuucagaaucacaaccaucagcagaucauuuuagacaagggcaugcugguggccaucgaugagcugaugcaaucucugaaucauaauggcgagacacuucgccagaaaccuccugugggagaagcagacccuuacagagugaagaugaagcucugcauccugcuucacgccuucagcacccgcgucgucacuauuaacagggugaugggcuaucugagcuccgccucugguggcggaucaggcggcggcggcucuggcggcgguggaagcggagguggcgggucuggcggagguucacugcagguaguagugaucagcgccauccuggcccugguggugcugaccgugaucucauugaucaucuugauuaugcuguggggcggaggaggcagcgggaaaccaauuccaaauccccuccugggguuggauagcacc

SEQ ID NO: 270 - RNA, 1839 nt, Artificial Sequence
  Synthetic: mIL12AB-8TM_v5_miR122 Nucleotide sequence
auguguccucagaagcuaaccaucuccugguuugccaucguuuuguuagugucuccacucauggccaugugggagcucgagaaagacguuuacguuguagagguggacuggacucccgacgccccaggcgaaacagugaaccucaccugugacacgccugaagaagaugacaucaccuggaccucagaccagagacauggagucauaggcucuggaaagacccugaccaucacugucaaagaguuccuagaugcuggccaguacaccugccacaaaggaggcgagacucugagccacucacaucugcugcuccacaagaaggagaauggaauuugguccacagaaauuuuaaagaacuucaagaacaagacuuuccugaagugugaagcaccaaauuacuccggacgguucacgugcucauggcuggugcaaagaaacauggacuugaaguucaacaucaagagcaguagcaguuccccugacucucgggcagugacauguggaauggcgucucugucugcagagaaggucacacuggaccaaagggacuaugagaaguauucaguguccugccaggaggaugucaccugcccaacugccgaggagacucugcccauugaacuggcguuggaagcacggcagcagaauaaauaugagaacuacagcaccagcuucuucaucagggacaucaucaaaccagacccgcccaagaacuugcagaugaagccuuugaagaacucacagguggaggucagcugggaguacccagacuccuggagcacuccccauuccuacuucucccucaaguucuuuguucgaauccagcgcaagaaagagaagaugaaggagacagaggagggguguaaccagaaaggugcguuccucguagagaagacaucuaccgaaguccaaugcaaaggcgggaaugucugcgugcaagcucaggaucgcuauuacaauuccucaugcagcaagugggcauguguucccugcaggguccgauccggaggcggagggaguggaggagguggcucuggcggcgguggaaguagggucauuccagucucuggaccugcacgcugucuuagccagucccgaaaccugcugaagaccacagacgacauggugaagacggccagagagaaacugaaacauuauuccugcacagcggaagacauagaucacgaggauaucacacgggaccaaaccagcacauugaagaccuguuuaccacuggaacuacacaagaacgagaguugccuggcuacuagagagacuucuuccacaacaagagggagcugccugccaccacagaagacgucuuugaugaugacccugugccuugguagcaucuaugaggaucugaagauguaccagacagaguuccaggccaucaacgcagcacuucagaaucacaaccaucagcagaucauuuuagacaagggcaugcugguggccaucgaugagcugaugcagucccugaaucauaauggugaaacguugcgccagaaaccuccugugggagaagcagacccuuacagagugaagaugaagcucugcauccugcuucacgccuucagcacccgcgucgugacuauaaacagggugaugggcuaucugagcuccgccucugguggcggaucaggaggagguggauccgguggcggugguuccggaggugguggaucgggugguggcucacugcagaucuacaucugggccccgcuggccggcaucugcguggcccugcugcugagccugaucaucacccugaucugcuacgguggaggcgguagcgggaaaccaauuccaaauccccuccugggguuggauagcacc

SEQ ID NO: 271 - RNA, 1869 nt, Artificial Sequence
  Synthetic: mIL12AB-80TM-ICD Nucleotide Sequence
auguguccucagaagcuaaccaucuccugguuugccaucguuuuguuggugucuccacucauggccaugugggagcucgagaaagacguuuacguuguagagguggacuggacucccgacgccccgggcgaaacagugaaccucaccugugacacgccugaagaagaugacaucaccuggaccucagaccagagacauggagucauaggcucuggaaagacccugaccaucacugucaaagaguuccuagaugcuggccaguacaccugccacaaaggaggcgagacucugagccacucacaucugcugcuccacaagaaggagaauggaauuugguccacugagauccugaagaacuucaagaauaagacuuuccugaagugugaagcaccaaauuacuccggacgguucacgugcucauggcuggugcaaagaaacauggacuugaaguucaacaucaagagcaguagcaguuccccugacucucgggcagugacauguggaauggcgucucugucugcagagaaggucacacuggaccaaagggacuaugagaaguauucaguguccugccaggaggaugucaccugcccaacugccgaggagacacugcccauugaacuggcguuggaagcacggcagcagaauaaauaugagaacuacagcaccagcuucuucaucagggacaucaucaaaccagacccgcccaagaacuugcagaugaagccuuugaagaacucacagguggaggucagcugggaguacccggacuccuggagcacuccccauuccuacuucucccucaaguucuuuguucgaauccagcgcaagaaagagaagaugaaggagacagaggagggguguaaccagaaaggugcguuccucguagagaagacaucuaccgaaguccaaugcaaaggcgggaaugucugcgugcaagcucaggaucgcuauuacaauuccucaugcagcaagugggcauguguucccugcaggguccgauccggaggcggagggagcggugguggaggcagcggaggagguggaucaagggucauuccagucucuggaccagcuagaugucuuagccagucccgaaaccugcugaagaccacggacgacauggugaagacggccagagagaaacugaaacauuauuccugcaccgcagaggauaucgaucacgaagauaucacacgggaccaaaccagcacauugaagaccuguuuaccacuggaacuacacaagaacgagaguugccuggcuacuagagagacuucuuccacaacaagagggagcugccugccaccacagaagacgucuuugaugaugacccugugccuugguagcaucuaugaggaccucaagauguaccagacagaguuccaggccaucaacgcagcacuucagaaucacaaccaucagcagaucauuuuagacaagggcaugcugguggccaucgaugagcugaugcaaucauugaaucauaacggugagacauugcgccagaaaccuccugugggagaagcagacccuuacagagugaagaugaagcucugcauccugcuucacgccuucagcacccgcgucgucacuaucaacagggugaugggcuaucugagcuccgccagcgguggcggaagcgguggaggcggcagcggcgguggugguagcggcggcggcggcuccggcggagggagccugcagacccuggugcuguucggcgccggcuucggugcagugaucaccgugguggugaucgucgucaucaucaagugcuucugcaagcacagaagcugcuucagaagaaacgaggccagcagagaaaccaacaacagccuaacauucggcccagaagaggcucuggcc

SEQ ID NO: 272 - RNA, 1818 nt, Artificial Sequence
  Synthetic: IgK-mscIL12AB-80TM-ICD Nucleotide
auggagacugacacccugcugcugugggugcuguuacuuuggguucccggcagcaccggcuaccccuacgacgugcccgacuacgccaugugggagcucgagaaagacguuuacguuguagagguggacuggacucccgacgccccgggcgaaacagugaaccucaccugugacacgccugaagaagaugacaucaccuggaccucagaccagagacauggagucauaggcucuggaaagacccugaccaucacugucaaagaguuccuagaugcuggccaguacaccugccacaaaggaggcgagacucugagccacucacaucugcugcuccacaagaaggagaauggaauuugguccacugagauccugaagaacuucaagaauaagacuuuccugaagugugaagcaccaaauuacuccggacgguucacgugcucauggcuggugcaaagaaacauggacuugaaguucaacaucaagagcaguagcaguuccccugacucucgggcagugacauguggaauggcgucucugucugcagagaaggucacacuggaccaaagggacuaugagaaguauucaguguccugccaggaggaugucaccugcccaacugccgaggagacacugcccauugaacuggcguuggaagcacggcagcagaauaaauaugagaacuacagcaccagcuucuucaucagggacaucaucaaaccagacccgcccaagaacuugcagaugaagccuuugaagaacucacagguggaggucagcugggaguacccggacuccuggagcacuccccauuccuacuucucccucaaguucuuuguucgaauccagcgcaagaaagagaagaugaaggagacagaggagggguguaaccagaaaggugcguuccucguagagaagacaucuaccgaaguccaaugcaaaggcgggaaugucugcgugcaagcucaggaucgcuauuacaauuccucaugcagcaagugggcauguguucccugcaggguccgaggaagcaccagcgguuccggcaaaccagguagcggagagggcagcaccaagggcagggucauuccagucucuggaccagcuagaugucuuagccagucccgaaaccugcugaagaccacggacgacauggugaagacggccagagagaaacugaaacauuauuccugcaccgcagaggauaucgaucacgaagauaucacacgggaccaaaccagcacauugaagaccuguuuaccacuggaacuacacaagaacgagaguugccuggcuacuagagagacuucuuccacaacaagagggagcugccugccaccacagaagacgucuuugaugaugacccugugccuugguagcaucuaugaggaccucaagauguaccagacagaguuccaggccaucaacgcagcacuucagaaucacaaccaucagcagaucauuuuagacaagggcaugcugguggccaucgaugagcugaugcaaucauugaaucauaacggugagacauugcgccagaaaccuccugugggagaagcagacccuuacagagugaagaugaagcucugcauccugcuucacgccuucagcacccgcgucgucacuaucaacagggugaugggcuaucugagcuccgccacccuggugcuguucggcgccggcuucggugcagugaucaccgugguggugaucgucgucaucaucaagugcuuuugcaagcacagaagcuguuucagaagaaacgaggccagcagagaaaccaacaacucccugacuuucgggcccgaggaagcccucgcc

SEQ ID NO: 273 - RNA, 1791 nt, Artificial Sequence
  Synthetic: hIL12AB-8TM Nucleotide Sequence
augugccaccagcagcuggugaucagcugguucagccugguguuccuggccagcccccugguggccaucugggagcugaagaaggacguguacgugguggaguuggauugguaccccgacgcccccggcgagaugguggugcugaccugcgacacccccgaggaggacggcaucaccuggacccuggaccagagcagcgaggugcugggcagcggcaagacccugaccauccaggugaaggaguucggcgacgccggccaguacaccugccacaagggcggcgaggugcugagccacagccugcugcugcugcacaagaaggaggacggcaucuggagcaccgacauccugaaggaccagaaggagcccaagaacaagaccuuccugagaugcgaggccaagaacuacagcggcagauucaccugcugguggcugaccaccaucagcaccgaccugaccuucagcgugaagagcagcagaggcagcagcgacccccagggcgugaccugcggcgccgccacccugagcgccgagagagugagaggcgacaacaaggaguacgaguacagcguggagugccaggaagauagcgccugccccgccgccgaggagagccugcccaucgaggugaugguggacgccgugcacaagcugaaguacgagaacuacaccagcagcuucuucaucagagauaucaucaagcccgacccccccaagaaccugcagcugaagccccugaagaacagccggcagguggaggugagcugggaguaccccgacaccuggagcaccccccacagcuacuucagccugaccuucugcgugcaggugcagggcaagagcaagagagagaagaaagauagaguguucaccgacaagaccagcgccaccgugaucugcagaaagaacgccagcaucagcgugagagcccaagauagauacuacagcagcagcuggagcgagugggccagcgugcccugcagcggcggcggcggcggcggcagcagaaaccugcccguggccacccccgaccccggcauguuccccugccugcaccacagccagaaccugcugagagccgugagcaacaugcugcagaaggcccggcagacccuggaguucuaccccugcaccagcgaggagaucgaccacgaagauaucaccaaagauaagaccagcaccguggaggccugccugccccuggagcugaccaagaacgagagcugccugaacagcagagagaccagcuucaucaccaacggcagcugccuggccagcagaaagaccagcuucaugauggcccugugccugagcagcaucuacgaggaccugaagauguaccagguggaguucaagaccaugaacgccaagcugcugauggaccccaagcggcagaucuuccuggaccagaacaugcuggccgugaucgacgagcugaugcaggcccugaacuucaacagcgagaccgugccccagaagagcagccuggaggagcccgacuucuacaagaccaagaucaagcugugcauccugcugcacgccuucagaaucagagccgugaccaucgacagagugaugagcuaccugaacgccagcucugguggcggaucaggcggcggcgguucaggaggcgguggaaguggagguggcgggucuggcggagguucacugcagaucuacaucugggcuccacuggccggcaccugcggcgugcugcugcugagccuggugaucacccuguacugcuacgggaaaccaauuccaaauccccuccugggguuggauagcacc

SEQ ID NO: 274 - RNA, 1749 nt, Artificial Sequence
  Synthetic: hIL12AB-8TM no epitope tag Nucleotide Sequence
augugccaccagcagcuggugaucagcugguucagccugguguuccuggccagcccccugguggccaucugggagcugaagaaggacguguacgugguggaguuggauugguaccccgacgcccccggcgagaugguggugcugaccugcgacacccccgaggaggacggcaucaccuggacccuggaccagagcagcgaggugcugggcagcggcaagacccugaccauccaggugaaggaguucggcgacgccggccaguacaccugccacaagggcggcgaggugcugagccacagccugcugcugcugcacaagaaggaggacggcaucuggagcaccgacauccugaaggaccagaaggagcccaagaacaagaccuuccugagaugcgaggccaagaacuacagcggcagauucaccugcugguggcugaccaccaucagcaccgaccugaccuucagcgugaagagcagcagaggcagcagcgacccccagggcgugaccugcggcgccgccacccugagcgccgagagagugagaggcgacaacaaggaguacgaguacagcguggagugccaggaagauagcgccugccccgccgccgaggagagccugcccaucgaggugaugguggacgccgugcacaagcugaaguacgagaacuacaccagcagcuucuucaucagagauaucaucaagcccgacccccccaagaaccugcagcugaagccccugaagaacagccggcagguggaggugagcugggaguaccccgacaccuggagcaccccccacagcuacuucagccugaccuucugcgugcaggugcagggcaagagcaagagagagaagaaagauagaguguucaccgacaagaccagcgccaccgugaucugcagaaagaacgccagcaucagcgugagagcccaagauagauacuacagcagcagcuggagcgagugggccagcgugcccugcagcggcggcggcggcggcggcagcagaaaccugcccguggccacccccgaccccggcauguuccccugccugcaccacagccagaaccugcugagagccgugagcaacaugcugcagaaggcccggcagacccuggaguucuaccccugcaccagcgaggagaucgaccacgaagauaucaccaaagauaagaccagcaccguggaggccugccugccccuggagcugaccaagaacgagagcugccugaacagcagagagaccagcuucaucaccaacggcagcugccuggccagcagaaagaccagcuucaugauggcccugugccugagcagcaucuacgaggaccugaagauguaccagguggaguucaagaccaugaacgccaagcugcugauggaccccaagcggcagaucuuccuggaccagaacaugcuggccgugaucgacgagcugaugcaggcccugaacuucaacagcgagaccgugccccagaagagcagccuggaggagcccgacuucuacaagaccaagaucaagcugugcauccugcugcacgccuucagaaucagagccgugaccaucgacagagugaugagcuaccugaacgccagcucugguggcggaucaggcggcggcgguucaggaggcgguggaaguggagguggcgggucuggcggagguucacugcagaucuacaucugggcuccacuggccggcaccugcggcgugcugcugcugagccuggugaucacccuguacugcuac

SEQ ID NO: 275 - RNA, 1812 nt, Artificial Sequence
  Synthetic: h12AB-80TID Nucleotide Sequence 1 matched
augugccaccagcagcuggugaucagcugguucagccugguguuccuggccagcccccugguggccaucugggagcugaagaaggacguguacgugguggaguuggauugguaccccgacgcccccggcgagaugguggugcugaccugcgacacccccgaggaggacggcaucaccuggacccuggaccagagcagcgaggugcugggcagcggcaagacccugaccauccaggugaaggaguucggcgacgccggccaguacaccugccacaagggcggcgaggugcugagccacagccugcugcugcugcacaagaaggaggacggcaucuggagcaccgacauccugaaggaccagaaggagcccaagaacaagaccuuccugagaugcgaggccaagaacuacagcggcagauucaccugcugguggcugaccaccaucagcaccgaccugaccuucagcgugaagagcagcagaggcagcagcgacccccagggcgugaccugcggcgccgccacccugagcgccgagagagugagaggcgacaacaaggaguacgaguacagcguggagugccaggaagauagcgccugccccgccgccgaggagagccugcccaucgaggugaugguggacgccgugcacaagcugaaguacgagaacuacaccagcagcuucuucaucagagauaucaucaagcccgacccccccaagaaccugcagcugaagccccugaagaacagccggcagguggaggugagcugggaguaccccgacaccuggagcaccccccacagcuacuucagccugaccuucugcgugcaggugcagggcaagagcaagagagagaagaaagauagaguguucaccgacaagaccagcgccaccgugaucugcagaaagaacgccagcaucagcgugagagcccaagauagauacuacagcagcagcuggagcgagugggccagcgugcccugcagcggcggcggcggcggcggcagcagaaaccugcccguggccacccccgaccccggcauguuccccugccugcaccacagccagaaccugcugagagccgugagcaacaugcugcagaaggcccggcagacccuggaguucuaccccugcaccagcgaggagaucgaccacgaagauaucaccaaagauaagaccagcaccguggaggccugccugccccuggagcugaccaagaacgagagcugccugaacagcagagagaccagcuucaucaccaacggcagcugccuggccagcagaaagaccagcuucaugauggcccugugccugagcagcaucuacgaggaccugaagauguaccagguggaguucaagaccaugaacgccaagcugcugauggaccccaagcggcagaucuuccuggaccagaacaugcuggccgugaucgacgagcugaugcaggcccugaacuucaacagcgagaccgugccccagaagagcagccuggaggagcccgacuucuacaagaccaagaucaagcugugcauccugcugcacgccuucagaaucagagccgugaccaucgacagagugaugagcuaccugaacgccagcucugguggcggaucaggcggcggcgguucaggaggcgguggaaguggagguggcgggucuggcggagguucacugcagcugcugcccagcugggccaucacccugaucagcgugaacggcaucuucgugaucugcugccugaccuacugcuucgccccucgaugcagagagagaagaagaaacgagagacugagaagagagagcgugcgacccgug

SEQ ID NO: 276 - RNA, 1812 nt, Artificial Sequence
  Synthetic: h12AB-80TID Nucleotide Sequence 2 SE_IL12_041
augugccaccagcagcuggugaucagcugguucagccugguguuccuggccagcccucugguggccaucugggagcugaagaaggacguguacgugguggagcuggacugguacccugacgccccuggcgagaugguggugcugaccugcgacaccccugaggaggacggcaucaccuggacccuggaccagagcagcgaggugcugggcagcggcaagacccugaccauccaggugaaggaguucggcgacgccggccaguacaccugccacaagggcggagagguguuaagccacagccugcucuugcuacacaagaaggaggacgguauuuggagcaccgacauccugaaggaccagaaggagccuaagaacaagaccuuccugaggugcgaggccaagaacuacagcggcagauucaccugcugguggcugaccaccaucuccacggaccugaccuucagcguuaagaguagcagaggcagcagcgacccucagggcgugacuuguggcgccgccacccugagcgccgagagagugagaggcgacaacaaggaguacgaguacagcguggagugccaggaggacagcgccugcccugccgccgaggagagccugccuaucgaggugaugguggacgccgugcacaagcugaaguacgagaauuacaccucauccuucuucaucagagacaucaucaagccugacccuccaaagaaucugcagcugaagccucugaagaacagcagacagguggaggugagcugggaguauccggauaccuggagcacaccucacagcuacuucucacuuacauucugcgugcaggugcagggcaagagcaagagagagaagaaggauagaguguucaccgacaagaccagcgccaccgugaucugcagaaagaacgccagcaucucagugagagcccaggacagauacuacucauccuccuggagcgagugggccagcgugccuugcuccgguggugguggcggaggcagcagaaaccugccuguggcuacaccugauccuggcauguucccuugccugcaccacagccagaaccugcugagagccgugagcaacaugcugcagaaggccagacagacucuggaguucuacccuugcaccagcgaggagaucgaccacgaggacaucaccaaggauaagacaagcaccguggaggccugccugccucuggagcugaccaagaacgagagcugccuaaacucuagggaaaccagcuucauuacuaacggcaguugcuuagccagccggaagacaucguucaugauggcccugugccugagcagcaucuacgaggaccugaagauguaccaaguggaguucaagaccaugaacgccaagcugcugauggacccuaagagacagaucuuccuagaccagaacaugcucgccgugaucgacgagcugaugcaggcccugaacuucaacagcgaaacugugccucagaagaguucacuggaggagccugacuucuauaagacuaagaucaagcuguguauucuccuccacgccuucagaaucagggcugucaccaucgauagggugaugagcuaccugaacgcaucguccggcggaggauccggaggaggaggcuccggcggugguggaaguggaggagguggaucaggaggcgguagucuccagcuccugccuagcugggccaucacccugaucucuguaaacggcauuuucgucauuugcugucugacuuacugcuucgccccuaggugccgggagcguaggagaaacgagagacugcgccgggaguccgugcggccugug

SEQ ID NO: 277 - RNA, 1812 nt, Artificial Sequence
  Synthetic: h12AB-80TID Nucleotide Sequence 3 SE_IL12_042
augugucaccagcagcucgugaucagcugguucagccugguguuccuggccuccccgcugguggccaucugggagcugaagaaggacguguacgugguggagcuggacugguaccccgacgcucccggcgagaugguggugcugaccugcgacacaccggaggaagacggaaucaccuggacccuggaccaauccuccgaaguucugggcagcggcaagacccugaccauccaggugaaggaguucggcgacgccggccaguacaccugccacaagggcggcgaggugcugagccacagccugcuccuccuccacaagaaagaggacggcaucuggagcaccgacauccugaaggaccagaaggagcccaagaacaagaccuuccugcggugcgaggccaagaacuacucaggccgauucaccuguugguggcucacaacuaucagcacagaccugaccuucagcgugaagucuagccggggcagcagcgauccucagggcgugaccugcggcgccgccacccugagcgccgagcgggugcggggcgacaacaaggaguacgaguacagcguggagugccaggaggacagcgccugcccggccgccgaagagucccugcccaucgaggugaugguggacgccgugcacaaacucaaguacgagaacuacaccuccagcuucuucauccgggacaucaucaagcccgauccgcccaagaaccugcagcugaagccccugaagaacagccggcagguggaggugagcugggaauacccggacacgugguccaccccacacagcuacuucagccugaccuuuugcgugcagguccaaggcaagagcaagcgggagaagaaggaccggguguucaccgauaagaccucagccaccgugauuugcagaaagaacgcauccauauccguacgcgcccaggaucgguacuacagcagcagcuggagcgagugggccagcgugcccuguagcggcggcggcgguggugggagucgcaaccugcccguggccaccccggaccccggcauguuccccugccugcaccacagccagaaccugcugcgggccgugagcaacaugcugcagaaggcccggcagacccuggaguucuaccccugcaccagcgaggagaucgaccacgaggacaucaccaaggacaagaccagcaccguggaggccugccugccccuggagcugaccaagaacgagagcugccugaacagucgcgaaaccuccuucauuacgaacggcagcugccuggccagccggaagaccagcuucaugauggcccugugccugagcagcaucuacgaggaccugaagauguaccagguggaguucaagaccaugaacgccaagcugcugauggaccccaagcggcagaucuuccuggaccagaacaugcuggccgugaucgacgagcugaugcaggcccugaacuucaacagcgaaaccgugccccagaaguccagccuggaggagcccgacuucuacaagaccaagaucaagcugugcauccugcugcacgccuuccggauccgggccgugaccaucgaccgggugaugagcuaccugaacgccucuuccgguggcgggagcggaggcgguggaucuggcggaggagggucgggaggcggcggaagcggugguggaagccuucaacugcugcccucgugggccaucacacugaucuccgugaacggcaucuucgugaucugcugccugaccuacugcuucgccccucggugccgcgagcgacggagaaacgagaggcucagacgggagagcgugcggcccgug

SEQ ID NO: 278 - RNA, 1812 nt, Artificial Sequence
  Synthetic: h12AB-80TID Nucleotide Sequence 4 SE_IL12_043
augugccaccaacagcuggugaucagcugguucagccugguguuccuggccucaccccugguggccaucugggagcugaagaaggacguguacgugguggagcuggacugguaccccgacgccccuggcgagaugguggugcugaccugcgacacgcccgaggaagacgguaucaccuggacucuggaccagagcagcgaggugcugggcagcggcaagacccugaccauccaggugaaggaguucggcgacgccggccaguacaccugccacaagggcggcgaagugcugagccacagccuucugcugcugcacaagaaggaggacggcauuuggagcaccgacauccugaaggaccagaaggagcccaagaacaagaccuuccugcggugcgaggccaagaacuacagcggccgguucaccugcugguggcugaccaccaucagcaccgaccuuaccuucagcguuaagagcagccggggcagcagcgauccccagggcgugaccugcggagccgccacccucuccgcagagcgggugcguggcgacaacaaggaguacgaguacagcguggagugccaggaggauagcgccugucccgcugccgaagagagccugcccaucgaggugaugguggacgccgugcacaagcugaaguacgagaacuacaccagcagcuucuucauccgggacaucaucaagcccgauccacccaagaaccugcagcugaagccccugaagaacagcaggcagguugaggugagcugggaauaccccgacaccuggagcaccccucacagcuacuucagccugaccuucugcgugcaggugcagggcaagagcaagcgggagaagaaggaucggguguucaccgauaagaccagcgccaccgugaucugccggaagaacgccagcaucagcguucgggcccaggaccgguacuacagcagcagcuggagcgagugggccagcgugcccugcucuggaggcggaggcggaggcucacggaaccugccaguggccacgccggaucccggcauguuccccugccugcaccacagccagaaccugcugcgggccgugagcaacaugcugcagaaggcccggcagacccuggaguucuaccccugcaccagcgaggagaucgaccacgaggacaucaccaaggacaagaccagcaccguggaggccugccugccccuggagcugaccaagaacgagagcugccugaacagccgggagacaagcuucaucaccaacggcagcugccuggccagccggaagaccagcuucaugauggcccugugccugagcagcaucuacgaggaccugaagauguaccagguggaguucaagaccaugaacgccaagcugcugauggaccccaagcggcagaucuuccuggaucagaacaugcuggccgugaucgacgagcugaugcaggcccugaacuucaacagcgagacugugccccagaaguccagccuggaggagcccgacuucuacaagaccaagaucaagcugugcauccugcugcacgccuuccggauccgggcugugaccaucgaccgggugaugagcuaccugaacgccucuuccggcggcggaucgggagguggagguucuggaggagguggaagcggugguggcggaagcggcgguggcagccugcaauugcuccccagcugggccaucacccugaucagcgugaacggcaucuucgugaucuguugccugaccuacugcuucgccccacggugccgggagagacggcggaacgagcggcugcggcgagagagcgugcggcccgug

SEQ ID NO: 279 - RNA, 1812 nt, Artificial Sequence
  Synthetic: h12AB-80TID Nucleotide Sequence 5 SE_IL12_044
augugucaccagcaguuggugauaucuugguucucacugguguuucuugcaucaccacucguggcgaucugggaacuuaagaaggacgucuacgugguggaguuagauugguauccugacgcacccggggaaaugguuguccucacgugcgacacuccagaggaagacgggaucaccuggacccuggaucagucgucagagguacuuggcaguggcaagacacugacaauccagguuaaagaguuuggugacgccgggcaguauacgugccacaagggcggcgagguguugucacauucucugcuucuccugcacaagaaagaagacggcaucuggucaacugacauccugaaagaccagaaagaacccaagaauaagaccuuccuccguugcgaagcaaagaacuacucagggcguuucacuugcugguggcuaaccacaauuucuaccgaucugacguucucugugaagucaaguaggggauccucagacccucaaggggucaccugcggcgccgccaccuuauccgccgaaagaguucggggugacaauaaagaguacgaguacagcgucgagugucaggaggacuccgccuguccugcugcagaggagucccugccgaucgaaguuaugguggacgccguccacaagcucaaauacgagaacuacaccucaagcuucuucaucagagacaucaucaagccugauccacccaagaaccugcaacugaagccuuugaagaacagccgacagguggagguuucuugggaauauccagacacguggaguacgccccauuccuacuucagcuugaccuucugcgugcagguucaggggaaguccaagagagagaagaaggaucguguguucacagacaagaccuccgccaccgugaucugccggaagaacgcaucuaucaguguuagggcccaggaucgguacuacucgaguuccuggucugagugggcaagugugcccugcuccgguggcggcggaggagggucaaggaaccugcccguugccacaccagauccaggaauguuccccugucugcaccacucucagaaccuuuugcgagccguuucuaauaugcuucagaaggcucggcagacccuugaguuuuaucccugcacgucugaggagaucgaucacgaggacaucaccaaggacaagacuuccaccguugaagccuguuuaccucuggaacugaccaagaacgaauccugucucaacaguagggaaacgagcuucaucacuaacggaagcugucuggcuagccggaagaccucuuuuaugauggcccugugcuugagcucuauuuacgaagauuugaagauguaccaaguggaauuuaagacuaugaacgccaaacugcugauggacccuaagcgccaaaucuucuuggaucagaauaugcuggcuguaaucgacgagcucaugcaggcucugaacuucaacagcgagacgguaccgcagaagaguucccuggaagaaccggacuucuacaagacuaagauuaaacucugcauacuccuccacgccuuccggaucagggccgucacaauagauagggucaugaguuaucuuaacgcgaguucuggugguggaucggguggcggaggcucaggaggaggcgguucuggcgguggugggaguggaggcgguagucugcagcugcugccgaguugggcaaucacgcuaaucagcgugaacggaauauucguaauuuguugccucaccuauuguuucgcacccaggugcagggaaaggaggcgaaacgaaagguugaggagggaaucuguccggccagug

SEQ ID NO: 280 - RNA, 549 nt, Homo sapiens
  misc_feature (1)..(549): Human PGFRB G739tr intracellular domain nucleotide sequence
cagaagaagcccagauacgagauccgguggaaggugaucgagagcgugagcagcgacggccacgaguucaucuucguggaccccaugcagcugcccuacgacagcaccugggagcugccccgugaucagcuggugcugggcagaacccugggcagcggcgccuucggccaggugguggaggcuaccgcccacggccugagccacagccaggccaccaugaagguggccguggccaugcucaagagcaccgccagaagcagcgagaagcaggcccugaugagcgagcugaagaucaugagccaucuggggccccaccugaacguggugaaccugcugggcgccugcaccaagggcggccccaucuacaucaucaccgaguacugcagauacggcgaccugguggacuaccugcacagaaacaagcacaccuuccugcagcaccacagcgacaagagaagaccucccagcgccgagcuguacagcaacgcccugcccguuggucugccccuacccagccacgugagccugaccggcgagagcgacggcggc

SEQ ID NO: 281 - RNA, 2298 nt, Artificial Sequence
  Synthetic: h12AB-PTM-ICD-E570tr Nucleotide Sequence
augugccaccagcagcuggugaucagcugguucagccugguguuccuggccagcccccugguggccaucugggagcugaagaaggacguguacgugguggaguuggauugguaccccgacgcccccggcgagaugguggugcugaccugcgacacccccgaggaggacggcaucaccuggacccuggaccagagcagcgaggugcugggcagcggcaagacccugaccauccaggugaaggaguucggcgacgccggccaguacaccugccacaagggcggcgaggugcugagccacagccugcugcugcugcacaagaaggaggacggcaucuggagcaccgacauccugaaggaccagaaggagcccaagaacaagaccuuccugagaugcgaggccaagaacuacagcggcagauucaccugcugguggcugaccaccaucagcaccgaccugaccuucagcgugaagagcagcagaggcagcagcgacccccagggcgugaccugcggcgccgccacccugagcgccgagagagugagaggcgacaacaaggaguacgaguacagcguggagugccaggaagauagcgccugccccgccgccgaggagagccugcccaucgaggugaugguggacgccgugcacaagcugaaguacgagaacuacaccagcagcuucuucaucagagauaucaucaagcccgacccccccaagaaccugcagcugaagccccugaagaacagccggcagguggaggugagcugggaguaccccgacaccuggagcaccccccacagcuacuucagccugaccuucugcgugcaggugcagggcaagagcaagagagagaagaaagauagaguguucaccgacaagaccagcgccaccgugaucugcagaaagaacgccagcaucagcgugagagcccaagauagauacuacagcagcagcuggagcgagugggccagcgugcccugcagcggcggcggcggcggcggcagcagaaaccugcccguggccacccccgaccccggcauguuccccugccugcaccacagccagaaccugcugagagccgugagcaacaugcugcagaaggcccggcagacccuggaguucuaccccugcaccagcgaggagaucgaccacgaagauaucaccaaagauaagaccagcaccguggaggccugccugccccuggagcugaccaagaacgagagcugccugaacagcagagagaccagcuucaucaccaacggcagcugccuggccagcagaaagaccagcuucaugauggcccugugccugagcagcaucuacgaggaccugaagauguaccagguggaguucaagaccaugaacgccaagcugcugauggaccccaagcggcagaucuuccuggaccagaacaugcuggccgugaucgacgagcugaugcaggcccugaacuucaacagcgagaccgugccccagaagagcagccuggaggagcccgacuucuacaagaccaagaucaagcugugcauccugcugcacgccuucagaaucagagccgugaccaucgacagagugaugagcuaccugaacgccagcucugguggcggaucaggcggcggcgguucaggaggcgguggaaguggagguggcgggucuggcggagguucacugcaggugguggugaucagcgccauccuggcccugguggugcucaccaucaucagccugaucauccugaucaugcuguggcagaagaagcccagauacgagauccgguggaaggugaucgagagcgugagcagcgacggccacgaguucaucuucguggaccccaugcagcugcccuacgacagcaccugggagcugccccgugaucagcuggugcugggcagaacccugggcagcggcgccuucggccaggugguggaggcuaccgcccacggccugagccacagccaggccaccaugaagguggccguggccaugcucaagagcaccgccagaagcagcgagaagcaggcccugaugagcgagcugaagaucaugagccaucuggggccccaccugaacguggugaaccugcugggcgccugcaccaagggcggccccaucuacaucaucaccgaguacugcagauacggcgaccugguggacuaccugcacagaaacaagcacaccuuccugcagcaccacagcgacaagagaagaccucccagcgccgagcuguacagcaacgcccugcccguuggucugccccuacccagccacgugagccugaccggcgagagcgacggcggc

SEQ ID NO: 282 - RNA, 2298 nt, Artificial Sequence; identical to SEQ ID NO: 281
  Synthetic: h12AB-PTM-ICD-G739tr Nucleotide Sequence

SEQ ID NO: 283 - RNA, 141 nt, Artificial Sequence
  Synthetic: 3UTR with mir-122-5p binding site
ugauaauaggcuggagccucgguggccuagcuucuugccccuugggccuccccccagccccuccuccccuuccugcacccguaccccccaaacaccauugucacacuccaguggucuuugaauaaagucugagugggcggc

SEQ ID NO: 284 - RNA, 918 nt, Artificial Sequence
  Synthetic: Wild Type IL12B without signal (IL12B) Nucleic Acids
auaugggaacugaagaaagauguuuaugucguagaauuggauugguauccggaugccccuggagaaauggugguccucaccugugacaccccugaagaagaugguaucaccuggaccuuggaccagagcagugaggucuuaggcucuggcaaaacccugaccauccaagucaaagaguuuggagaugcuggccaguacaccugucacaaaggaggcgagguucuaagccauucgcuccugcugcuucacaaaaaggaagauggaauuugguccacugauauuuuaaaggaccagaaagaacccaaaaauaagaccuuucuaagaugcgaggccaagaauuauucuggacguuucaccugcugguggcugacgacaaucaguacugauuugacauucagugucaaaagcagcagaggcucuucugacccccaaggggugacgugcggagcugcuacacucucugcagagagagucagaggggacaacaaggaguaugaguacucaguggagugccaggaggacagugccugcccagcugcugaggagagucugcccauugaggucaugguggaugccguucacaagcucaaguaugaaaacuacaccagcagcuucuucaucagggacaucaucaaaccugacccacccaagaacuugcagcugaagccauuaaagaauucucggcagguggaggucagcugggaguacccugacaccuggaguacuccacauuccuacuucucccugacauucugcguucagguccagggcaagagcaagagagaaaagaaagauagagucuucacggacaagaccucagccacggucaucugccgcaaaaaugccagcauuagcgugcgggcccaggaccgcuacuauagcucaucuuggagcgaaugggcaucugugcccugcagu

SEQ ID NO: 285 - RNA, 591 nt, Artificial Sequence
  Synthetic: Wild Type IL12A without signal peptide Nucleic acids
agaaaccuccccguggccacuccagacccaggaauguucccaugccuucaccacucccaaaaccugcugagggccgucagcaacaugcuccagaaggccagacaaacucuagaauuuuacccuugcacuucugaagagauugaucaugaagauaucacaaaagauaaaaccagcacaguggaggccuguuuaccauuggaauuaaccaagaaugagaguugccuaaauuccagagagaccucuuucauaacuaaugggaguugccuggccuccagaaagaccucuuuuaugauggcccugugccuuaguaguauuuaugaagacuugaagauguaccagguggaguucaagaccaugaaugcaaagcuucugauggauccuaagaggcagaucuuucuagaucaaaacaugcuggcaguuauugaugagcugaugcaggcccugaauuucaacagugagacugugccacaaaaauccucccuugaagaaccggauuuuuauaaaacuaaaaucaagcucugcauacuucuucaugcuuucagaauucgggcagugacuauugauagagugaugagcuaucugaaugcuucc

SEQ ID NO: 286 - RNA, 41 nt, Artificial Sequence
  Synthetic: 5UTR
gggaaauaagagagaaaagaagaguaagaagaaauauaaga

SEQ ID NO: 287 - RNA, 57 nt, Artificial Sequence
  Synthetic: V1 - 5 UTR
gggaaauaagagagaaaagaagaguaagaagaaauauaagaccccggcgccgccacc

SEQ ID NO: 288 - RNA, 54 nt, Artificial Sequence
  Synthetic: V2 - 5UTR
gggaaauaagagagaaaagaagaguaagaagaaauauaagaccccggcgccacc

SEQ ID NO: 289 - RNA, 47 nt, Artificial Sequence; identical to SEQ ID NO: 82
  Synthetic: Standard 5UTR

SEQ ID NO: 290 - RNA, 1596 nt, Artificial Sequence
  Synthetic: hIL12AB_001 ORF
augugucaccagcagcuggucauuagcugguuuagccuuguguuccuggccuccccccuugucgcuauuugggagcucaagaaggacguguacgugguggagcuggacugguacccagacgcgcccggagagaugguaguucugaccugugauaccccagaggaggacggcaucaccuggacucuggaccaaagcagcgagguuuugggcucagggaaaacgcugaccauccaggugaaggaauucggcgacgccggacaguacaccugccauaagggaggagaggugcugagccauucccuucuucugcugcacaagaaagaggacggcaucuggucuaccgacauccugaaagaccagaaggagcccaagaacaaaaccuuccugaggugcgaggccaagaacuacuccggcagguucacuuguugguggcugaccaccaucaguacagaccugacuuuuaguguaaaaagcuccagaggcucguccgauccccaaggggugaccugcggcgcagccacucugagcgcugagcgcgugcgcggugacaauaaagaguacgaguacagcguugagugucaagaagacagcgcuugcccugccgccgaggagagccugccuaucgaggugaugguugacgcagugcacaagcuuaaguacgagaauuacaccagcucauucuucauuagagauauaaucaagccugacccacccaagaaccugcagcugaagccacugaaaaacucacggcaggucgaagugagcugggaguaccccgacaccuggagcacuccucauuccuauuucucucuuacauucugcguccaggugcagggcaagagcaagcgggaaaagaaggaucgagucuucaccgacaaaacaagcgcgaccgugauuugcaggaagaacgccagcaucuccgucagagcccaggauagauacuauaguagcagcuggagcgagugggcaagcgugcccuguuccggcggcgggggcgggggcagccgaaacuugccugucgcuaccccggacccuggaauguuuccgugucugcaccacagccagaaccugcugagagccgugucgaauaugcuccagaaggcccggcagacccuugaguucuaccccuguaccagcgaagagaucgaucaugaggacaucacgaaagacaagacuuccaccgucgaggcuugucucccgcuggagcugaccaagaacgagagcugucugaauagccgggagacaucuuucaucacgaaugguagcugucuggccagcaggaaaacuuccuucaugauggcucucugccugagcucuaucuaugaagaucugaagauguaucagguggaguuuaagacuaugaacgccaaacuccugauggacccaaaaaggcaaaucuuucuggaccagaauaugcuggccgugauagacgagcugaugcaggcacugaacuucaacagcgagacagugccacagaaauccagccuggaggagccugacuuuuacaaaacuaagaucaagcuguguauccugcugcacgccuuuagaauccgugccgugacuaucgacagggugaugucauaccucaacgcuuca

SEQ ID NO: 291 - RNA, 1596 nt, Artificial Sequence
  Synthetic: hIL12AB_002 ORF
augugccaccagcagcuggugaucagcugguucagccugguguuccuggccagcccccugguggccaucugggagcugaagaaggacguguacgugguggagcuggacugguaccccgacgcccccggcgagaugguggugcugaccugcgacacccccgaggaggacggcaucaccuggacccuggaccagagcagcgaggugcugggcagcggcaagacccugaccauccaggugaaggaguucggcgacgccggccaguacaccugccacaagggcggcgaggugcugagccacagccugcugcugcugcacaagaaggaggacggcaucuggagcaccgacauccugaaggaccagaaggagcccaagaacaagaccuuccugagaugcgaggccaagaacuacagcggcagauucaccugcugguggcugaccaccaucagcaccgaccugaccuucagcgugaagagcagcagaggcagcagcgacccccagggcgugaccugcggcgccgccacccugagcgccgagagagugagaggcgacaacaaggaguacgaguacagcguggagugccaggaggacagcgccugccccgccgccgaggagagccugcccaucgaggugaugguggacgccgugcacaagcugaaguacgagaacuacaccagcagcuucuucaucagagacaucaucaagcccgacccccccaagaaccugcagcugaagccccugaagaacagcagacagguggaggugagcugggaguaccccgacaccuggagcaccccccacagcuacuucagccugaccuucugcgugcaggugcagggcaagagcaagagagagaagaaggacagaguguucaccgacaagaccagcgccaccgugaucugcagaaagaacgccagcaucagcgugagagcccaggacagauacuacagcagcagcuggagcgagugggccagcgugcccugcagcggcggcggcggcggcggcagcagaaaccugcccguggccacccccgaccccggcauguuccccugccugcaccacagccagaaccugcugagagccgugagcaacaugcugcagaaggccagacagacccuggaguucuaccccugcaccagcgaggagaucgaccacgaggacaucaccaaggacaagaccagcaccguggaggccugccugccccuggagcugaccaagaacgagagcugccugaacagcagagagaccagcuucaucaccaacggcagcugccuggccagcagaaagaccagcuucaugauggcccugugccugagcagcaucuacgaggaccugaagauguaccagguggaguucaagaccaugaacgccaagcugcugauggaccccaagagacagaucuuccuggaccagaacaugcuggccgugaucgacgagcugaugcaggcccugaacuucaacagcgagaccgugccccagaagagcagccuggaggagcccgacuucuacaagaccaagaucaagcugugcauccugcugcacgccuucagaaucagagccgugaccaucgacagagugaugagcuaccugaacgccagc

SEQ ID NO: 292 - RNA, 1596 nt, Artificial Sequence
  Synthetic: hIL12AB_003  ORF
augugucaccagcaguuggucaucucuugguuuucccugguuuuucuggcaucuccccucguggccauaugggaacugaagaaagauguuuaugucguagaauuggauugguauccggaugccccuggagaaauggugguccucaccugugacaccccugaagaagaugguaucaccuggaccuuggaccagagcagugaggucuuaggcucuggcaaaacccugaccauccaagucaaagaguuuggagaugcuggccaguacaccugucacaaaggaggcgagguucuaagccauucgcuccugcugcuucacaaaaaggaagauggaauuugguccacugauauuuuaaaggaccagaaagaacccaaaaauaagaccuuucuaagaugcgaggccaagaauuauucuggacguuucaccugcugguggcugacgacaaucaguacugauuugacauucagugucaaaagcagcagaggcucuucugacccccaaggggugacgugcggagcugcuacacucucugcagagagagucagaggggacaacaaggaguaugaguacucaguggagugccaggaggacagugccugcccagcugcugaggagagucugcccauugaggucaugguggaugccguucacaagcucaaguaugaaaacuacaccagcagcuucuucaucagggacaucaucaaaccugacccacccaagaacuugcagcugaagccauuaaagaauucucggcagguggaggucagcugggaguacccugacaccuggaguacuccacauuccuacuucucccugacauucugcguucagguccagggcaagagcaagagagaaaagaaagauagagucuucacggacaagaccucagccacggucaucugccgcaaaaaugccagcauuagcgugcgggcccaggaccgcuacuauagcucaucuuggagcgaaugggcaucugugcccugcaguggcggagggggcggagggagcagaaaccuccccguggccacuccagacccaggaauguucccaugccuucaccacucccaaaaccugcugagggccgucagcaacaugcuccagaaggccagacaaacuuuagaauuuuacccuugcacuucugaagagauugaucaugaagauaucacaaaagauaaaaccagcacaguggaggccuguuuaccauuggaauuaaccaagaaugagaguugccuaaauuccagagagaccucuuucauaacuaaugggaguugccuggccuccagaaagaccucuuuuaugauggcccugugccuuaguaguauuuaugaagacuugaagauguaccagguggaguucaagaccaugaaugcaaagcuucugauggauccuaagaggcagaucuuuuuagaucaaaacaugcuggcaguuauugaugagcugaugcaggcccugaauuucaacagugagacugugccacaaaaauccucccuugaagaaccggacuucuacaagaccaagaucaagcucugcauacuucuucaugcuuucagaauucgggcagugacuauugauagagugaugagcuaucugaaugcuucc

SEQ ID NO: 293 - RNA, 1599 nt, Artificial Sequence
  Synthetic: hIL12AB_004 ORF
augggcugccaccagcagcuggucaucagcugguucucccuggucuuccuggccagcccccugguggccaucugggagcugaagaaagaugucuauguuguagagcuggacugguacccagaugcuccuggagaaauggugguucucaccugugacacgccagaagaagauggcaucaccuggacgcuggaccagagcucagaaguucuuggcaguggaaaaacgcugaccauacaaguaaaagaauuuggggaugcuggccaguacaccugccacaaaggaggagaaguucucagccacagccugcugcugcugcacaagaaagaagauggcaucuggagcacagacauuuuaaaagaccagaaggagcccaagaacaaaaccuuccuucgaugugaggccaagaacuacaguggccgcuucaccugcugguggcucaccaccaucagcacagaccucaccuucucggugaagagcagccguggcagcucagacccccaaggagucaccuguggggcggccacgcugucggcagaaagaguucgaggggacaacaaggaauaugaauacucgguggaaugucaagaagacucggccugcccggcggcagaagaaagucuucccauagaagucaugguggaugcuguucacaaauuaaaauaugaaaacuacaccagcagcuucuucaucagagacaucaucaagccagacccgcccaagaaccugcagcugaagccccugaagaacagcagacaaguggaaguuuccugggaguacccagacacguggagcacgccgcacagcuacuucagccucaccuucuguguacaaguacaaggcaagagcaagagagagaagaaagaucgugucuucacagacaaaaccucggcgacggucaucugcaggaagaaugccuccaucucgguucgagcccaggaccgcuacuacagcagcagcuggagugagugggccucggugcccugcagugguggcggcggcggcggcagcagaaaccuuccuguggccacgccggacccuggcauguucccgugccugcaccacagccaaaauuuacuucgagcuguuucuaacaugcugcagaaagcaagacaaacuuuagaauucuaccccugcaccucagaagaaauagaccaugaagacaucaccaaagauaaaaccagcacuguagaggccugccugccccuggagcucaccaagaaugaauccugccucaacagcagagagaccagcuucaucaccaauggcagcugccuggccagcaggaaaaccagcuucaugauggcgcucugccugagcagcaucuaugaagauuugaagauguaccaaguagaauuuaaaaccaugaaugccaagcugcucauggaccccaagagacaaauauuuuuggaucaaaacaugcuggcugucauugaugagcucaugcaagcauuaaacuucaacucagagacggugccccagaagagcagccuggaggagccagacuucuacaaaaccaagaucaagcucugcaucuuauuacaugccuuccgcauccgggcggucaccauugaccgugucauguccuacuuaaaugccagc

SEQ ID NO: 294 - RNA, 1596 nt, Artificial Sequence
  Synthetic: hIL12AB_005 ORF
augugccaccagcagcuggucaucagcugguucucccuggucuuccuggccagcccccugguggccaucugggagcugaagaaagaugucuauguuguagagcuggacugguacccagaugcuccuggagaaauggugguucucaccugugacacgccagaagaagauggcaucaccuggacgcuggaccagagcucagaaguucuuggcaguggaaaaacgcugaccauacaaguaaaagaauuuggggaugcuggccaguacaccugccacaaaggaggagaaguucucagccacagccugcugcugcugcacaagaaagaagauggcaucuggagcacagacauuuuaaaagaccagaaggagcccaagaacaaaaccuuccuucgaugugaggccaagaacuacaguggccgcuucaccugcugguggcucaccaccaucagcacagaccucaccuucucggugaagagcagccguggcagcucagacccccaaggagucaccuguggggcggccacgcugucggcagaaagaguucgaggggacaacaaggaauaugaauacucgguggaaugucaagaagacucggccugcccggcggcagaagaaagucuucccauagaagucaugguggaugcuguucacaaauuaaaauaugaaaacuacaccagcagcuucuucaucagagacaucaucaagccagacccgcccaagaaccugcagcugaagccccugaagaacagcagacaaguggaaguuuccugggaguacccagacacguggagcacgccgcacagcuacuucagccucaccuucuguguacaaguacaaggcaagagcaagagagagaagaaagaucgugucuucacagacaaaaccucggcgacggucaucugcaggaagaaugccuccaucucgguucgagcccaggaccgcuacuacagcagcagcuggagugagugggccucggugcccugcagugguggcggcggcggcggcagcagaaaccuuccuguggccacgccggacccuggcauguucccgugccugcaccacagccaaaauuuacuucgagcuguuucuaacaugcugcagaaagcaagacaaacuuuagaauucuaccccugcaccucagaagaaauagaccaugaagacaucaccaaagauaaaaccagcacuguagaggccugccugccccuggagcucaccaagaaugaauccugccucaacagcagagagaccagcuucaucaccaauggcagcugccuggccagcaggaaaaccagcuucaugauggcgcucugccugagcagcaucuaugaagauuugaagauguaccaaguagaauuuaaaaccaugaaugccaagcugcucauggaccccaagagacaaauauuuuuggaucaaaacaugcuggcugucauugaugagcucaugcaagcauuaaacuucaacucagagacggugccccagaagagcagccuggaggagccagacuucuacaaaaccaagaucaagcucugcaucuuauuacaugccuuccgcauccgggcggucaccauugaccgugucauguccuacuuaaaugccagc

SEQ ID NO: 295 - RNA, 1596 nt, Artificial Sequence
  Synthetic: hIL12AB_006 ORF
augugccaccagcagcuggugaucagcugguucagccugguguuccuggccagcccccugguggccaucugggagcugaagaaggacguguacgugguggagcuggacugguaccccgacgcccccggcgagaugguggugcugaccugugacacccccgaggaggacggcaucaccuggacccuggaccagagcagcgaggugcugggcagcggcaagacccugaccauccaggugaaggaguucggggacgccggccaguacaccugccacaagggcggcgaggugcugagccacagccugcugcugcugcacaagaaggaggacggcaucuggagcacagauauccugaaggaccagaaggagcccaagaacaagaccuuccugagaugcgaggccaagaacuacagcggcagauucaccugcugguggcugaccaccaucagcacagacuugaccuucagcgugaagagcagcagaggcagcagcgacccccagggcgugaccugcggcgccgccacccugagcgccgagagagugagaggggacaacaaggaguacgaguacagcguggagugccaggaggacagcgccugccccgccgccgaggagagccugcccaucgaggugaugguggacgccgugcacaagcugaaguacgagaacuacaccagcagcuucuucaucagagacaucaucaagcccgacccgccgaagaaccugcagcugaagccccugaagaacagcagacagguggaggugagcugggaguaccccgacaccuggagcaccccccacagcuacuucagccugaccuucugcgugcaggugcagggcaagagcaagagagagaagaaggacagaguguucacagauaagaccagcgccaccgugaucugcagaaagaacgccagcaucagcgugagagcccaggacagauacuacagcagcagcuggagcgagugggccagcgugcccugcagcggcggcggcggcggcggcagcagaaaccugcccguggccacccccgaccccggcauguuccccugccugcaccacagccagaaccugcugagagccgugagcaacaugcugcagaaggccagacagacccuggaguucuaccccugcaccagcgaggagaucgaccacgaggacaucaccaaggacaagaccagcaccguggaggccugccugccccuggagcugaccaagaaugaaagcugccugaacagcagagagaccagcuucaucaccaacggcagcugccuggccagcagaaagaccagcuucaugauggcccugugccugagcagcaucuacgaggaccugaagauguaccagguggaguucaagaccaugaacgccaagcugcugauggaccccaagagacagaucuuccuggaccagaacaugcuggccgugaucgacgagcugaugcaggcccugaacuucaacagcgagaccgugccccagaagagcagccuggaggagcccgacuucuacaagaccaagaucaagcugugcauccugcugcacgccuucagaaucagagccgugaccaucgacagagugaugagcuaccugaacgccagc

SEQ ID NO: 296 - RNA, 1596 nt, Artificial Sequence
  Synthetic: hIL12AB_007 ORF
augugccaccagcagcuugucaucuccugguucucucuugucuuccuugcuucuccucuuguggccaucugggagcugaagaaggauguuuauguuguggaguuggacugguacccugaugcuccuggagaaauggugguucucaccugugacacuccugaggaggauggcaucaccuggacuuuggaccagucuucugagguucuuggcaguggaaaaacucuuacuauucaggugaaggaguuuggagaugcuggccaguacaccugccacaaggguggugaaguucucagccacaguuuacuucuucuucacaagaaggaggauggcaucuggucuacugacauuuuaaaagaccagaaggagcccaagaacaagacuuuccuucguugugaagccaagaacuacaguggucguuucaccugcugguggcuuacuacuauuucuacugaccuuacuuucucugugaagucuucucguggcucuucugacccucagggugucaccuguggggcugcuacucuuucugcugagcgugugcguggggacaacaaggaguaugaauacucgguggagugccaggaggacucugccugcccugcugcugaggagucucuuccuauugaggugaugguggaugcugugcacaaguuaaaauaugaaaacuacacuucuucuuucuucauucgugacauuauaaaaccugacccucccaagaaccuucaguuaaaaccuuuaaaaaacucucgucagguggagguguccugggaguacccugacacguggucuacuccucacuccuacuucucucuuacuuucuguguccaggugcagggcaaguccaagcgugagaagaaggaccgugucuucacugacaagacuucugcuacugucaucugcaggaagaaugcauccaucucugugcgugcucaggaccguuacuacagcucuuccuggucugagugggcuucugugcccugcucuggcggcggcggcggcggcagcagaaaucuuccuguggcuacuccugacccuggcauguuccccugccuucaccacucgcagaaccuucuucgugcugugagcaacaugcuucagaaggcucgucagacuuuagaauucuaccccugcacuucugaggagauugaccaugaagacaucaccaaggacaagacuucuacuguggaggccugccuuccuuuagagcugaccaagaaugaauccugcuuaaauucucgugagacuucuuucaucaccaauggcagcugccuugccucgcgcaagacuucuuucaugauggcucuuugccuuucuuccaucuaugaagacuuaaaaauguaccagguggaguucaagaccaugaaugcaaagcuucucauggaccccaagcgucagauauuuuuggaccagaacaugcuugcugucauugaugagcucaugcaggcuuuaaacuucaacucugagacugugccucagaagucuucuuuagaagagccugacuucuacaagaccaagauaaaacuuugcauucuucuucaugcuuuccgcauccgugcugugacuauugaccgugugauguccuacuuaaaugcuucu

SEQ ID NO: 297 - RNA, 1596 nt, Artificial Sequence
  Synthetic: hIL12AB_008 ORF
augugucaucaacaacucgugauuagcugguucagucucguguuccuggccucuccgcugguggccaucugggagcuuaagaaggacguguacgugguggagcucgauugguaccccgaugcuccuggcgagaugguggugcuaaccugcgauacccccgaggaggacgggaucacuuggacccuggaucagaguagcgaaguccugggcucuggcaagacacucacaauccaggugaaggaauucggagacgcuggucaguacacuugccacaaggggggugaagugcugucucacagccugcuguuacugcacaagaaggaggaugggaucuggucaaccgacauccugaaggaucagaaggagccuaagaacaagaccuuucugaggugugaagcuaagaacuauuccggaagauucacuugcuggugguugaccacaaucagcacugaccugaccuuuuccgugaaguccagcagaggaagcagcgauccucagggcguaacgugcggcgcggcuacccugucagcugagcggguuagaggcgacaacaaagaguaugaguacuccguggagugucaggaggacagcgccugccccgcagccgaggagagucugcccaucgaggugaugguggacgcuguccauaaguuaaaauacgaaaauuacacaaguuccuuuuucauccgcgauauuaucaaacccgauccccccaagaaccugcagcugaagccccugaagaauagccgacagguggaagucucuugggaguauccugacaccugguccacgccucacagcuacuuuagucugacuuucuguguccagguccagggcaagagcaagagagagaaaaaggauagaguguuuacugacaagacaucugcuacagucaucugcagaaagaacgccaguaucucagugagggcgcaggacagauacuacaguaguagcuggagcgaaugggcuagcgugcccuguucagggggcggcggagggggcuccaggaaucugcccguggccacccccgacccugggauguucccuugccuccaucacucacagaaccugcucagagcagugagcaacaugcuccaaaaggcccgccagacccuggaguuuuacccuuguacuucagaagagaucgaucacgaagacauaacaaaggauaaaaccagcaccguggaggccugucugccucuagaacucacaaagaaugaaagcugucugaauuccagggaaaccuccuucauuacuaacggaagcugucucgcaucucgcaaaacaucauucaugauggcccucugccugucuucuaucuaugaagaucucaagauguaucagguggaguucaaaacaaugaacgccaagcugcugauggaccccaagagacagaucuuccuggaccagaacaugcuggcagugaucgaugagcugaugcaagccuugaacuucaacucagagacagugccgcaaaaguccucguuggaggaaccagauuuuuacaaaaccaaaaucaagcuguguauccuucuucacgccuuucggaucagagccgugacuaucgaccgggugaugucauaccugaaugcuucc

SEQ ID NO: 298 - RNA, 1596 nt, Artificial Sequence
  Synthetic: hIL12AB_009 ORF
augugccaccagcagcuggucaucagcugguuuagccuggucuuccuggccagcccccugguggccaucugggagcugaagaaagaugucuauguuguagagcuggacugguacccagaugcuccuggagaaauggugguucucaccugcgacacgccagaagaagauggcaucaccuggacgcuggaccagagcagcgaaguacugggcaguggaaaaacgcugaccauacaaguaaaagaauuuggcgaugcuggccaguacaccugccacaaaggaggagaaguacugagccacagccugcugcugcugcacaagaaagaagauggcaucuggagcaccgacauuuuaaaagaccagaaggagcccaagaacaaaaccuuccuucgaugugaggcgaagaacuacaguggccgcuucaccugcugguggcucaccaccaucagcaccgaccucaccuucucggugaagagcagccgugguagcucagacccccaaggagucaccuguggggcggccacgcugucggcagaaagaguucgaggcgacaacaaggaauaugaauacucgguggaaugucaagaagacucggccugcccggcggcagaagaaagucugcccauagaagucaugguggaugcuguucacaaauuaaaauaugaaaacuacaccagcagcuucuucaucagagacaucaucaagccagacccccccaagaaccugcagcugaagccccugaagaacagcagacaaguggaaguuuccugggaguacccagacacguggagcacgccgcacagcuacuucagccucaccuucuguguacaaguacaaggcaagagcaagagagagaagaaagaucgugucuucaccgacaaaaccucggcgacggucaucugcaggaagaaugcaagcaucucgguucgagcccaggaccgcuacuacagcagcagcuggagugagugggccucggugcccugcagugguggcggcggcggcggcagcagaaaccuuccuguggccacgccggacccuggcauguuuccgugccugcaccacagccaaaauuuauuacgagcuguuagcaacaugcugcagaaagcaagacaaacuuuagaauucuaccccugcaccucagaagaaauagaccaugaagacaucaccaaagauaaaaccagcacuguagaggccugccugccccuggagcucaccaagaacgagagcugccucaauagcagagagaccagcuucaucaccaauggcagcugccuggccagcaggaaaaccagcuucaugauggcgcucugccugagcagcaucuaugaagaucugaagauguaccaaguagaauuuaaaaccaugaaugccaagcugcucauggaccccaagagacaaauauuccucgaccaaaacaugcuggcugucauugaugagcucaugcaagcauuaaacuucaacucagagacggugccccagaagagcagccuggaggagccagacuucuacaaaaccaagaucaagcucugcaucuuauuacaugccuuccgcauccgggcggucaccauugaccgugucauguccuacuuaaaugccagc

SEQ ID NO: 299 - RNA, 1596 nt, Artificial Sequence
  Synthetic: hIL12AB_010 ORF
augugccaccagcagcuugucaucuccugguuuucucuugucuuccucgcuucuccucuuguggccaucugggagcugaagaaagaugucuauguuguagagcuggacugguacccggacgcuccuggagaaauggugguucucaccugcgacacuccugaagaagauggcaucaccuggacgcuggaccaaagcagcgaaguuuuaggcucuggaaaaacgcugaccauacaaguaaaagaauuuggcgacgcuggccaguacacgugccacaaaggaggagaaguuuuaagccacaguuuacuucuucuucacaagaaagaagauggcaucuggaguacggacauuuuaaaagaccagaaggagccuaagaacaaaaccuuccuccgcugugaagcuaagaacuacaguggucguuucaccugcugguggcucaccaccaucuccacugaccucaccuucucuguaaaaucaagccgugguucuucugacccccaaggagucaccuguggggcugccacgcucagcgcugaaagaguucgaggcgacaacaaggaauaugaauauucuguggaaugucaagaagauucugccugcccggcggcagaagaaagucuucccauagaagucaugguggacgcuguucacaaauuaaaauaugaaaacuacaccagcagcuucuucauucgugacaucaucaaaccagacccuccuaagaaccuucaguuaaaaccgcugaagaacagcagacaaguggaaguuuccugggaguacccggacacguggaguacgccgcacuccuacuucaguuuaaccuucuguguacaaguacaaggaaaaucaaaaagagagaagaaagaucgugucuucacugacaaaacaucugccacggucaucugccguaagaacgcuuccaucucgguucgagcccaggaccgcuacuacagcagcagcuggagugagugggcaucuguucccugcagugguggcggcggcggcggcagccgcaaccuuccuguggccacgccggacccuggcauguucccgugccuucaccacucgcaaaaucuucuucgugcuguuucuaacaugcugcagaaggcgagacaaacuuuagaauucuacccgugcacuucugaagaaauagaccaugaagacaucaccaaggacaaaaccagcacgguggaggccugccuuccuuuagaacuuacuaagaacgaaaguugccuuaacagccgugagaccagcuucaucaccaauggcagcugccuugcuagcaggaagaccagcuucaugauggcgcugugccuuucuuccaucuaugaagaucuuaagauguaccaaguagaauuuaaaaccaugaaugccaaauuauuaauggaccccaagagacaaauauuccucgaccaaaacaugcuggcugucauugaugagcucaugcaagcauuaaacuucaacucagaaacuguuccccagaagucaucuuuagaagaaccggacuucuacaaaacaaaaauaaaacucugcauucuucuucaugccuuccgcauccgugcugucaccauugaccgugucauguccuacuuaaaugcuucu

SEQ ID NO: 300 - RNA, 1596 nt, Artificial Sequence
  Synthetic: hIL12AB_011 ORF
augugccaccagcagcuggugaucagcugguucagccugguguuccuggccagcccccugguggccaucugggagcugaagaaggacguguacgugguggagcuggacugguacccggacgcgccgggggagaugguggugcugacgugcgacacgccggaggaggacgggaucacguggacgcuggaccagagcagcgaggugcuggggagcgggaagacgcugacgauccaggugaaggaguucggggacgcggggcaguacacgugccacaaggggggggaggugcugagccacagccugcugcugcugcacaagaaggaggacgggaucuggagcacggacauccugaaggaccagaaggagccgaagaacaagacguuccugaggugcgaggcgaagaacuacagcgggagguucacgugcugguggcugacgacgaucagcacggaccugacguucagcgugaagagcagcagggggagcagcgacccgcagggggugacgugcggggcggcgacgcugagcgcggagagggugaggggggacaacaaggaguacgaguacagcguggagugccaggaggacagcgcgugcccggcggcggaggagagccugccgaucgaggugaugguggacgcggugcacaagcugaaguacgagaacuacacgagcagcuucuucaucagggacaucaucaagccggacccgccgaagaaccugcagcugaagccgcugaagaacagcaggcagguggaggugagcugggaguacccggacacguggagcacgccgcacagcuacuucagccugacguucugcgugcaggugcaggggaagagcaagagggagaagaaggacaggguguucacggacaagacgagcgcgacggugaucugcaggaagaacgcgagcaucagcgugagggcgcaggacagguacuacagcagcagcuggagcgagugggcgagcgugccgugcagcggggggggggggggggggagcaggaaccugccgguggcgacgccggacccggggauguucccgugccugcaccacagccagaaccugcugagggcggugagcaacaugcugcagaaggcgaggcagacgcuggaguucuacccgugcacgagcgaggagaucgaccacgaggacaucacgaaggacaagacgagcacgguggaggcgugccugccgcuggagcugacgaagaacgagagcugccugaacagcagggagacgagcuucaucacgaacgggagcugccuggcgagcaggaagacgagcuucaugauggcgcugugccugagcagcaucuacgaggaccugaagauguaccagguggaguucaagacgaugaacgcgaagcugcugauggacccgaagaggcagaucuuccuggaccagaacaugcuggcggugaucgacgagcugaugcaggcgcugaacuucaacagcgagacggugccgcagaagagcagccuggaggagccggacuucuacaagacgaagaucaagcugugcauccugcugcacgcguucaggaucagggcggugacgaucgacagggugaugagcuaccugaacgcgagc

SEQ ID NO: 301 - RNA, 1596 nt, Artificial Sequence
  Synthetic: hIL12AB_012 ORF
augugccaucagcagcuggugaucagcugguucagccucguguuucuggccagcccccugguggccauuugggaacucaagaaggacguguauguaguggaacucgacugguacccugacgccccaggcgaaaugguggucuuaaccugcgacaccccugaggaggacggaaucaccuggaccuuggaccagagcuccgagguccucggcaguggcaagacccugaccauacaggugaaagaauuuggagacgcagggcaauacacaugucacaagggcggggagguucuuucucacucccuucugcuucuacauaaaaaggaagacggaauuuggucuaccgacauccucaaggaccaaaaggagccuaagaauaaaaccuucuuacgcugugaagcuaaaaacuacagcggcagauucacuugcugguggcucaccaccauuucuaccgaccugaccuucucggugaagucuucaaggggcucuagugauccacagggagugacaugcggggccgccacacugagcgcugaacgggugaggggcgauaacaaggaguaugaauacucugucgagugucaggaggauucagcuugucccgcagcugaagagucacuccccauagagguuauggucgaugcugugcauaaacugaaguacgaaaacuacaccagcagcuucuucauucgggacauuauaaaaccugacccccccaagaaccugcaacuuaaaccccugaaaaacucucggcaggucgaaguuagcugggaguacccugauacuugguccaccccccacucguacuucucacugacuuucugugugcaggugcagggcaagagcaagagagagaaaaaagaucguguauucacagacaagaccucugccaccgugaucugcagaaaaaacgcuuccaucagugucagagcccaagaccgguacuauaguaguagcuggagcgagugggcaaguguccccugcucuggcggcggagggggcggcucucgaaaccuccccgucgcuaccccugauccaggaauguucccuugccugcaucacucacagaaucugcugagagcggucagcaacaugcugcagaaagcuaggcaaacacuggaguuuuauccuuguaccucagaggagaucgaccacgaggauauuaccaaggacaagaccagcacgguggaggccugcuugccccuggaacugacaaagaaugaauccugccuuaauagccgugagaccucuuuuauaacaaacggauccugccuggccagcaggaagaccuccuucaugauggcccucugccuguccucaaucuacgaagaccugaagauguaccagguggaauuuaaaacuaugaacgccaagcuguugauggaccccaagcggcagaucuuucuggaucaaaauaugcuggcugugaucgacgaacugaugcaggcccucaacuuuaacagcgagaccgugccacaaaagagcagucuugaggagcccgacuucuacaagaccaagaucaagcugugcauccuccuucaugccuucaggauaagagcugucaccaucgacagagucaugaguuaccugaaugcaucc

SEQ ID NO: 302 - RNA, 1596 nt, Artificial Sequence
  Synthetic: hIL12AB_013 ORF
augugccaccagcagcuggucaucuccugguucagucuugucuuccuggccucgccgcugguggccaucugggagcugaagaaagauguuuauguuguagagcuggacugguacccagaugcuccuggagaaauggugguccucaccugugacacgccagaagaagauggcaucaccuggacgcuggaccagagcagugaaguucuuggaaguggaaaaacgcugaccauacaaguaaaagaauuuggagaugcuggccaguacaccugccacaaaggaggagaaguucucagccacaguuuauuauuacuucacaagaaagaagauggcaucugguccacggacauuuuaaaagaccagaaggagcccaaaaauaaaacauuucuucgaugugaggccaagaacuacaguggucguuucaccugcugguggcugaccaccaucuccacagaccucaccuucaguguaaaaagcagccgugguucuucugacccccaaggagucaccuguggggcugccacgcucucugcagaaagaguucgaggggacaacaaagaauaugaguacucgguggaaugucaagaagacucggccugcccagcugcugaggagagucuucccauagaagucaugguggaugcuguucacaaauuaaaauaugaaaacuacaccagcagcuucuucaucagagacaucaucaaaccugacccgcccaagaacuuacagcugaagccgcugaaaaacagcagacaaguagaaguuuccugggaguacccggacaccugguccacgccgcacuccuacuucucccucaccuucuguguacaaguacaaggcaagagcaagagagagaagaaagaucgugucuucacggacaaaacaucagccacggucaucugcaggaaaaaugccagcaucucggugcgggcccaggaccgcuacuacagcagcagcuggagugagugggcaucugugcccugcagugguggugggggugguggcagcagaaaccuuccuguggccacuccagacccuggcauguucccgugccuucaccacucccaaaauuuacuucgagcuguuucuaacaugcugcagaaagcaagacaaacuuuagaauucuacccgugcacuucugaagaaauugaccaugaagacaucacaaaagauaaaaccagcacaguggaggccugucuuccuuuagagcugaccaaaaaugaauccugccucaacagcagagagaccagcuucaucaccaauggcagcugccuggccuccaggaaaaccagcuucaugauggcgcucugccucagcuccaucuaugaagauuugaagauguaccaaguagaauuuaaaaccaugaaugccaaauuauuaauggaccccaagaggcagauauuuuuagaucaaaacaugcuggcaguuauugaugagcucaugcaagcauuaaacuucaacagugagacuguaccucaaaaaagcagccuugaagagccggacuucuacaaaaccaagaucaaacucugcauuuuacuucaugccuuccgcauccgggcggucaccauugaccgugucauguccuacuuaaaugccucg

SEQ ID NO: 303 - RNA, 1596 nt, Artificial Sequence
  Synthetic: hIL12AB_014 ORF
augugccaccagcagcuugugauuucuugguucucucuuguguuccuugcuucuccucuuguggcuauuugggaguuaaaaaaggacguguacgugguggagcuugacugguacccugaugcuccuggcgagaugguggugcuuacuugugacacuccugaggaggacggcauuacuuggacucuugaccagucuucugaggugcuuggcucuggcaagacucuuacuauucaggugaaggaguucggggaugcuggccaguacacuugccacaagggcggcgaggugcuuucucacucucuucuucuucuucacaagaaggaggacggcauuuggucuacugacauuuuaaaagaccagaaggagcccaagaacaagacuuuccuucguugcgaggccaagaacuacucuggccguuucacuugcugguggcuuacuacuauuucuacugaccuuacuuucucugugaagucuucucguggcucuucugacccucagggcgugacuuguggggcugcuacucuuucugcugagcgugugcguggggacaacaaggaguacgaguacucuguggagugccaggaggacucugcuugcccugcugcugaggagucucuuccuauugaggugaugguggaugcugugcacaaguuaaaauacgagaacuacacuucuucuuucuucauucgugacauuauuaagccugacccucccaagaaccuucaguuaaaaccuuuaaaaaacucucgucagguggaggugucuugggaguacccugacacuuggucuacuccucacucuuacuucucucuuacuuucugcgugcaggugcagggcaagucuaagcgugagaagaaggaccguguguucacugacaagacuucugcuacugugauuugcaggaagaaugcaucuauuucugugcgugcucaggaccguuacuacucuucuucuuggucugagugggcuucugugccuugcucuggcggcggcggcggcggcucuagaaaucuuccuguggcuacuccugacccuggcauguucccuugccuucaccacucucagaaccuucuucgugcugugagcaacaugcuucagaaggcucgucagacucuugaguucuacccuugcacuucugaggagauugaccacgaggacaucaccaaggacaagacuucuacuguggaggcuugccuuccucuugagcuuaccaagaaugaaucuugcuuaaauucucgugagacuucuuucaucaccaacggcucuugccuugccucgcgcaagacuucuuucaugauggcucuuugccuuucuucuauuuacgaggacuuaaaaauguaccagguggaguucaagacuaugaaugcaaagcuucuuauggaccccaagcgucagauuuuccuugaccagaacaugcuugcugugauugacgagcuuaugcaggcuuuaaauuucaacucugagacugugccucagaagucuucucuugaggagccugacuucuacaagaccaagauuaagcuuugcauucuucuucaugcuuuccguauucgugcugugacuauugaccgugugaugucuuacuuaaaugcuucu

SEQ ID NO: 304 - RNA, 1596 nt, Artificial Sequence
  Synthetic: hIL12AB_015 ORF
augugucaccagcagcuggugaucagcugguuuagccugguguuucuggccagcccccugguggccauaugggaacugaagaaagauguguaugugguagaacuggauugguauccggaugcccccggcgaaaugguggugcugaccugugacacccccgaagaagaugguaucaccuggacccuggaccagagcagcgaggugcugggcagcggcaaaacccugaccauccaagugaaagaguuuggcgaugccggccaguacaccugucacaaaggcggcgaggugcuaagccauucgcugcugcugcugcacaaaaaggaagauggcaucuggagcaccgauauccugaaggaccagaaagaacccaaaaauaagaccuuucuaagaugcgaggccaagaauuauagcggccguuucaccugcugguggcugacgaccaucagcaccgaucugaccuucagcgugaaaagcagcagaggcagcagcgacccccaaggcgugacgugcggcgccgccacccugagcgccgagagagugagaggcgacaacaaggaguaugaguacagcguggagugccaggaggacagcgccugccccgccgccgaggagagccugcccaucgaggugaugguggaugccgugcacaagcugaaguaugaaaacuacaccagcagcuucuucaucagagacaucaucaaacccgacccccccaagaaccugcagcugaagccccugaagaauagcagacagguggaggugagcugggaguaccccgacaccuggagcaccccccauagcuacuucagccugaccuucugcgugcaggugcagggcaagagcaagagagaaaagaaagauagaguguucacggacaagaccagcgccacggugaucugcagaaaaaaugccagcaucagcgugagagcccaggacagauacuauagcagcagcuggagcgaaugggccagcgugcccugcagcggcggcggcggcggcggcagcagaaaccugcccguggccacccccgaccccggcauguuccccugccugcaccacagccaaaaccugcugagagccgugagcaacaugcugcagaaggccagacaaacccuggaauuuuaccccugcaccagcgaagagaucgaucaugaagauaucaccaaagauaaaaccagcaccguggaggccugucugccccuggaacugaccaagaaugagagcugccuaaauagcagagagaccagcuucauaaccaauggcagcugccuggccagcagaaagaccagcuuuaugauggcccugugccugagcagcaucuaugaagaccugaagauguaccagguggaguucaagaccaugaaugccaagcugcugauggaucccaagagacagaucuuucuggaucaaaacaugcuggccgugaucgaugagcugaugcaggcccugaauuucaacagcgagaccgugccccaaaaaagcagccuggaagaaccggauuuuuauaaaaccaaaaucaagcugugcauacugcugcaugccuucagaaucagagccgugaccaucgauagagugaugagcuaucugaaugccagc

SEQ ID NO: 305 - RNA, 1596 nt, Artificial Sequence
  Synthetic: hIL12AB_016 ORF
augugccaccagcagcuggucaucagcugguucagccuggucuuccuggccagcccccugguggccaucugggagcugaagaaggauguuuauguuguggagcuggacugguacccagaugccccuggggagaugguggugcugaccugugacaccccagaagaggauggcaucaccuggacccuggaccagagcucagaagugcugggcaguggaaaaacccugaccauccaggugaaggaguuuggagaugcuggccaguacaccugccacaaggguggugaagugcugagccacagccugcugcugcugcacaagaaggaggauggcaucuggagcacagacauccugaaggaccagaaggagcccaagaacaagaccuuccuucgcugugaagccaagaacuacaguggccgcuucaccugcugguggcugaccaccaucagcacagaccucaccuucucggugaagagcagcagaggcagcucagacccccagggugucaccuguggggcggccacgcugucggcggagagaguucgaggggacaacaaggaguaugaauacucgguggagugccaggaggacucggcgugcccggcggcagaagagagccugcccauagaagugaugguggaugcugugcacaagcugaaguaugaaaacuacaccagcagcuucuucaucagagacaucaucaagccagacccgcccaagaaccugcagcugaagccccugaagaacagcagacaaguggagguuuccugggaguacccagacacguggagcaccccccacagcuacuucagccugaccuucuguguccaggugcagggcaagagcaagagagagaagaaggacagagucuucacagacaagaccucggccacggucaucugcagaaagaaugccuccaucucgguucgagcccaggacagauacuacagcagcagcuggucagaaugggccucggugcccugcagugguggcggcggcggcggcagcagaaaccugccuguugccaccccagacccugggauguuccccugccugcaccacagccagaacuuauuacgagcuguuucuaacaugcugcagaaggccagacaaacccuggaguucuaccccugcaccucagaagagauugaccaugaagacaucaccaaggacaagaccagcacuguagaggccugccugccccuggagcugaccaagaaugaaagcugccugaacagcagagagaccagcuucaucaccaauggaagcugccuggccagcagaaagaccagcuucaugauggcccugugccugagcagcaucuaugaagaccugaagauguaccagguggaguucaagaccaugaaugcaaagcugcugauggaccccaagagacaaauauuuuuggaccagaacaugcuggcugucauugaugagcugaugcaggcccugaacuucaacucagaaacuguaccccagaagagcagccuggaggagccagacuucuacaagaccaagaucaagcugugcauccugcuucaugcuuucagaaucagagcugucaccauugaccgcgugaugagcuacuuaaaugccucg

SEQ ID NO: 306 - RNA, 1596 nt, Artificial Sequence
  Synthetic: hIL12AB_017 ORF
augugccaccagcagcugguaaucagcugguuuucccucgucuuucuggcaucaccccugguggcuaucugggagcugaagaaggacguguacgugguggagcuggauugguacccugacgccccgggggaaauggugguguuaacaugcgacacgccugaggaggacggcaucaccuggacacuggaccagagcagcgaggugcuugggucugguaaaacucugacuauucaggugaaagaguucggggaugccggccaauauacuugccacaaggguggcgaggugcuuucucauucucugcuccugcugcacaagaaagaagauggcauuuggucuacugauauucugaaagaccagaaggagcccaagaacaagaccuuucugagaugcgaggcuaaaaacuacagcggaagauuuaccugcugguggcugaccacaaucucaaccgaccugacauuuucagugaaguccagcagagggagcuccgacccucagggcgugaccugcggagccgccacucuguccgcagaaagagugagaggugauaauaaggaguacgaguauucagucgagugccaagaggacucugccugcccagccgccgaggagagccugccaaucgaggugaugguagaugcgguacacaagcugaaguaugagaacuacacauccuccuucuucauaagagacauuaucaagccugacccaccuaaaaaucugcaacucaagccuuugaaaaauucaagacagguggaggugagcugggaguacccugauacuuggagcaccccccauagcuacuuuucgcugacauucugcguccaggugcagggcaagucaaagagagagaagaaggaucgcguguucacugauaagacaagcgccacagugaucugcagaaaaaacgcuagcauuagcgucagagcacaggaccgguauuacuccagcuccuggagcgaaugggcaucugugcccugcagcggugggggcggaggcggaucuagaaaccuccccguugccacaccugauccuggaauguuccccugucugcaccacagccagaaccugcugagagcagugucuaacaugcuccagaaggccaggcagacccuggaguuuuaccccugcaccagcgaggaaaucgaucacgaggacaucaccaaagauaaaaccuccaccguggaggccugccugccccuggaacugaccaaaaacgagagcugccugaauagcagggagaccuccuucaucaccaacggcucaugccuugccagccggaaaacuagcuucaugauggcccugugccugucuucgaucuaugaggaccugaaaauguaccaggucgaauuuaagacgaugaacgcaaagcugcugauggaccccaagcggcagaucuuucuggaccagaacaugcuggcagucauagaugaguugaugcaggcauuaaacuucaacagcgagaccgugccucagaaguccagccucgaggagccagauuuuuauaagaccaagaucaaacuaugcauccugcugcaugcuuucaggauuagagccgucaccaucgaucgagucaugucuuaccugaaugcuagc

SEQ ID NO: 307 - RNA, 1596 nt, Artificial Sequence
  Synthetic: hIL12AB_018 ORF
augugucaccaacaguuaguaaucuccugguuuucucugguguuucuggccagcccccucguggccaucugggagcuuaaaaaggauguguacgugguggagcuggacugguaucccgaugcaccaggcgaaauggucgugcugaccugcgauaccccugaagaagauggcaucaccuggacucuggaccagucuuccgaggugcuuggaucuggcaagacucugacaauacaaguuaaggaguucggggacgcaggacaguacaccugccacaaaggcggcgagguccugagucacucccuguuacugcuccacaagaaagaggacggcauuugguccaccgacauucugaaggaccagaaggagccuaagaauaaaacuuuccugagaugcgaggcaaaaaacuauagcggccgcuuuacuugcugguggcuuacaacaaucucuaccgauuuaacuuucuccgugaagucuagcagaggauccucugacccgcaaggagugacuugcggagccgccaccuugagcgccgaaagaguccguggcgauaacaaagaauacgaguacuccguggagugccaggaagauuccgccugcccagcugccgaggagucccugcccauugaagugaugguggaugccguccacaagcugaaguacgaaaacuauaccagcagcuucuucauccgggauaucauuaagcccgacccuccuaaaaaccugcaacuuaagccccuaaagaauagucggcagguugaggucagcugggaauauccugacacauggagcaccccccacucuuauuucucccugaccuucugcgugcaggugcagggcaagaguaaacgggagaaaaaggacagggucuuuaccgauaaaaccagcgcuacgguuaucugucggaagaacgcuuccaucuccguccgcgcucaggaucguuacuacucguccucauggagcgagugggccagcgugcccugcagcggcggcgguggaggcggauccagaaaucugccuguugccacaccagacccuggcauguuccccugucugcaucauagccagaaccugcucagagccgugagcaacaugcuccagaaggccaggcagacauuggaguucuacccguguacaucugaggaaaucgaucacgaagauauaaccaaggacaaaaccucuacaguagaggcuuguuugccccuggaguugaccaaaaacgagaguugccugaacagucgcgagacaagcuucauuacuaacggcagcugucucgccuccagaaagacauccuucaugauggcccugugucuuuccagcauauacgaagaccugaaaauguaccaggucgaguucaaaacaaugaacgccaagcugcuuauggaccccaagagacagaucuuccucgaccaaaacaugcucgcugugaucgaugagcugaugcaggcucucaacuucaauuccgaaacagugccacagaaguccagucuggaagaacccgacuucuacaagaccaagauuaagcuguguauuuugcugcaugcguuuagaaucagagccgugaccauugaucgggugaugagcuaccugaacgccucg

SEQ ID NO: 308 - RNA, 1596 nt, Artificial Sequence
  Synthetic: hIL12AB_019 ORF
augugccaccagcagcuugucaucuccugguuuucucuugucuuccuggccucgccgcugguggccaucugggagcugaagaaagaugucuauguuguagagcuggacugguacccagaugcuccuggagaaauggugguucucaccugugacacuccugaagaagauggcaucaccuggacgcuggaccaaagcucagaaguucuuggcaguggaaaaacgcugaccauacaaguaaaagaauuuggggaugcuggccaguacacgugccacaaaggaggagaaguucucagccacaguuuacuucuucuucacaagaaagaagauggcaucugguccacggacauuuuaaaagaccagaaggagcccaagaacaaaaccuuccuccgcugugaggccaagaacuacaguggucguuucaccugcugguggcucaccaccaucuccacugaccucaccuucucuguaaaaagcagccgugguucuucugacccccaaggagucaccuguggggcugccacgcucucggcagaaagaguucgaggggacaacaaggaauaugaauauucuguggaaugucaagaagauucugccugcccggcggcagaagaaagucuucccauagaagucaugguggaugcuguucacaaauuaaaauaugaaaacuacaccagcagcuucuucauucgugacaucaucaaaccagacccgcccaagaaccuucaguuaaaaccuuuaaaaaacagcagacaaguagaaguuuccugggaguacccggacacgugguccacgccgcacuccuacuucaguuuaaccuucuguguacaaguacaaggaaaaucaaaaagagagaagaaagaucgugucuucacugacaaaacaucugccacggucaucugcaggaagaaugccuccaucucgguucgagcccaggaccgcuacuacagcagcagcuggagugagugggcaucuguucccugcagugguggcggcggcggcggcagccgcaaccuuccuguggccacgccggacccuggcauguucccgugccuucaccacucccaaaaucuucuucgugcuguuucuaacaugcugcagaaggcgcgccaaacuuuagaauucuacccgugcacuucugaagaaauagaccaugaagacaucaccaaagauaaaaccagcacgguggaggccugccuuccuuuagagcugaccaagaaugaauccugccucaacagcagagagaccagcuucaucaccaauggcagcugccuggccucgcgcaagaccagcuucaugauggcgcugugccuuucuuccaucuaugaagauuuaaagauguaccaaguagaauuuaaaaccaugaaugccaaauuauuaauggaccccaaaagacaaauauuuuuggaucaaaacaugcuggcugucauugaugagcucaugcaagcauuaaacuucaacucagaaacuguuccccagaagucaucuuuagaagagccggacuucuacaaaacaaaaauaaaacucugcauucuucuucaugccuuccgcauccgugcugucaccauugaccgugucauguccuacuuaaaugcuucu

SEQ ID NO: 309 - RNA, 1596 nt, Artificial Sequence
  Synthetic: hIL12AB_020 ORF
augugccaccagcagcuggugaucagcugguucagccugguguuccuggcuagcccucugguggccaucugggagcugaagaaggacguguacgugguggaguuagacugguaccccgacgcucccggcgagaugguggugcugaccugcgacacccccgaggaggacgggaucaccuggacccuggaucagucaagcgaggugcugggaagcggcaagacccugaccauccaggugaaggaguucggcgacgccggccaauacacuugccacaagggaggcgaggugcugucccacucccuccugcugcugcacaaaaaggaagacggcaucuggagcaccgacauccugaaagaccagaaggagccuaagaacaagacauuccucagaugcgaggccaagaauuacuccgggagauucaccuguugguggcugaccaccaucagcacagaccugaccuucagcgugaagagcagcagaggcagcagcgacccccagggcgugaccuguggcgccgccacccugagcgccgaaagagugcgcggcgacaacaaggaguacgaguacuccguggaaugccaggaggacagcgccugccccgccgccgaggagagccugcccaucgaggugaugguggacgccguccacaagcugaaguacgagaacuacaccucuagcuucuucauccgggacaucaucaagcccgauccccccaagaaccugcagcugaaaccccugaagaacagcagacagguggaggugagcugggaguaucccgacaccugguccaccccccacagcuauuuuagccugaccuucugcgugcaagugcagggcaagagcaagagagagaagaaggaccgcguguucaccgacaaaaccagcgccaccgugaucugcagaaagaacgccagcaucagcgugagggcccaggauagauacuacaguuccagcuggagcgagugggccagcgugcccugcagcggcggcggcgggggaggcucuagaaaccugcccguggcuacccccgaucccggaauguuccccugccugcaccacagccagaaccugcugagggcgguguccaacaugcuucagaaggcccggcagacccuggaguucuaccccuguaccucugaggagaucgaucaugaggacaucacaaaggacaaaaccagcaccguggaggccugccugccccuggagcugaccaagaacgagagcugccugaacucccgcgagaccagcuucaucacgaacggcagcugccuggccagcaggaagaccuccuucaugauggcccugugccugagcagcaucuacgaggaccugaaaauguaccagguggaguuuaagaccaugaacgccaagcugcugauggaccccaagcggcaaaucuuccuggaccagaacaugcuggcagugaucgacgagcucaugcaggcccugaacuucaauagcgagacagucccccagaagagcagccuggaggagcccgacuuuuacaagaccaagaucaagcugugcauccugcugcacgccuuuagaauccgugccgugaccauugacagagugaugagcuaccugaaugccagc

SEQ ID NO: 310 - RNA, 1596 nt, Artificial Sequence
  Synthetic: hIL12AB_021 ORF
augugccaccagcagcuggugaucagcugguucagccugguguuccuggccagcccucugguugccaucugggagcugaagaaagacguguacgucguggaacuggacugguauccggacgccccgggcgagaugguggugcugaccugugacacccccgaggaggacggcaucaccuggacgcuggaccaauccuccgaggugcugggaagcggcaagacccugaccauccaggugaaggaauucggggacgccgggcaguacaccugccacaaggggggcgaagugcugucccacucgcugcugcuccugcauaagaaggaggauggaaucugguccaccgacauccucaaagaucagaaggagcccaagaacaagacguuccugcgcugugaagccaagaauuauucggggcgauucacgugcugguggcugacaaccaucagcaccgaccugacguuuagcgugaagagcagcaggggguccagcgacccccagggcgugacgugcggcgccgccacccucuccgccgagagggugcggggggacaauaaggaguacgaguacagcguggaaugccaggaggacagcgccugccccgccgcggaggaaagccucccgauagaggugaugguggacgccgugcacaagcucaaguaugagaauuacaccagcagcuuuuucauccgggacauuaucaagcccgaccccccgaagaaccuccagcugaagccccugaagaacagccggcagguggaagucuccugggaguaucccgacaccuggagcaccccgcacagcuacuucucccugaccuucugugugcaggugcagggcaaguccaagagggaaaagaaggacaggguuuucaccgacaagaccagcgcgaccgugaucugccggaagaacgccagcauaagcguccgcgcccaagauagguacuacagcagcuccuggagcgagugggcuagcgugcccugcagcgggggcgggggugggggcuccaggaaccugccaguggcgacccccgaccccggcauguuccccugccuccaucacagccagaaccugcugagggccgucagcaauaugcugcagaaggccaggcagacccuggaauucuaccccugcacgucggaggagaucgaucacgaggauaucacaaaagacaagacuuccaccguggaggccugccugccccuggagcucaccaagaaugaguccugucugaacucccgggaaaccagcuucaucaccaacggguccugccuggccagcaggaagaccagcuuuaugauggcccugugccugucgagcaucuacgaggaccugaagauguaccaggucgaguucaagacaaugaacgccaagcugcugauggaccccaagaggcaaaucuuccuggaccagaauaugcuugccgucaucgacgagcucaugcaggcccugaacuucaacuccgagaccgugccccagaagagcagccuggaggagcccgacuucuacaagaccaagaucaagcugugcauccugcugcacgcguucaggauccgggcagucaccaucgaccgugugauguccuaccugaacgccagc

SEQ ID NO: 311 - RNA, 1596 nt, Artificial Sequence
  Synthetic: hIL12AB_022 ORF
augugccaucagcagcuggugaucagcugguucagccugguguuccucgccucuccccugguggccaucugggagcucaaaaaggacguguacgugguggagcucgacugguacccagacgcccccggggagaugguggugcugaccugcgacacccccgaagaagacggcaucacguggacccucgaccaguccagcgaggugcuggggagcgggaagacucugaccauccaggucaaggaguucggggacgccgggcaguacacgugccacaagggcggcgaagucuuaagccacagccugcuccugcugcacaagaaggaggacgggaucugguccacagacauacugaaggaccagaaggagccgaagaauaaaaccuuucugaggugcgaggccaagaacuauuccggcagguucacgugcugguggcuuacaacaaucagcacagaccugacguucagcgugaaguccagccgcggcagcagcgacccccagggggugaccugcggcgccgccacccugagcgccgagcgggugcgcggggacaacaaggaguacgaguacuccguggagugccaggaagacagcgccugucccgccgccgaagagagccugccuaucgaggucaugguagaugcagugcauaagcugaaguacgagaacuauacgagcagcuuuuucauacgcgacaucaucaagcccgacccccccaagaaccugcagcuuaagccccugaagaauagccggcagguggaggucuccugggaguaccccgacaccuggucaacgccccacagcuacuucucccugaccuuuuguguccaaguccagggaaagagcaagagggagaagaaagaucggguguucaccgacaagaccuccgccacggugaucugcaggaagaacgccagcaucuccgugagggcgcaagacagguacuacuccagcagcugguccgaaugggccagcgugcccugcuccggcggcgggggcggcggcagccgaaaccuacccguggccacgccggaucccggcauguuucccugccugcaccacagccagaaccuccugagggccguguccaacaugcugcagaaggccaggcagacucuggaguucuaccccugcacgagcgaggagaucgaucacgaggacaucaccaaggauaagaccagcacuguggaggccugccuuccccuggagcugaccaagaacgagagcugucugaacuccagggagaccucauucaucaccaacggcuccugccuggccagcaggaaaaccagcuucaugauggccuugugucucagcuccaucuacgaggaccugaagauguaucaggucgaguucaagacaaugaacgccaagcugcugauggaccccaaaaggcagaucuuccuggaccagaacaugcuggccgucaucgacgagcugaugcaggcccugaacuucaacagcgagacggugccccagaaaagcucccuggaggagcccgacuucuacaagaccaagaucaagcugugcauccugcugcacgccuucaggaucagggcagugaccaucgaccgggugaugucauaccuuaacgccagc

SEQ ID NO: 312 - RNA, 1596 nt, Artificial Sequence
  Synthetic: hIL12AB_023 ORF
augugccaucagcagcuggugaucuccugguucagccugguguuucuggccucgccccuggucgccaucugggagcugaagaaagacguguacgucgucgaacuggacugguaccccgacgcccccggggagaugguggugcugaccugcgacacgccggaggaggacggcaucaccuggacccuggaucaaagcagcgaggugcugggcagcggcaagacccugaccauccaagugaaggaauucggcgaugccggccaguacaccugucacaaagggggcgaggugcucagccacagccugcugcugcugcacaagaaggaggauggcaucuggagcaccgauauccugaaggaccagaaagagcccaagaacaagacguuccugaggugcgaggccaagaacuacagcgguagguucacguguugguggcugaccaccaucagcaccgaccugacguucagcgugaagagcuccaggggcagcuccgacccacagggggugacgugcggggccgcaacccucagcgccgaaagggugcggggggacaacaaggaguacgaauacuccguggagugccaggaagauucggccugccccgccgcggaggagagccuccccaucgagguaaugguggacgccgugcauaagcugaaguacgagaacuacaccagcucguucuucauccgagacaucaucaaacccgacccgcccaaaaaucugcagcucaagccccugaagaacuccaggcagguggaggugagcugggaguaccccgacaccugguccaccccgcacagcuacuucucccugacauucugcgugcaggugcagggcaagagcaagcgggagaagaaggacaggguguucaccgacaagacgagcgccaccgugaucugccgaaagaacgccagcaucucggugcgcgcccaggauagguacuauuccagcuccuggagcgagugggccucgguacccugcagcggcggcgggggcggcggcaguaggaaucugcccguggcuaccccggacccgggcauguuccccugccuccaccacagccagaaccugcugagggccgugagcaacaugcugcagaaggccagacagacgcuggaguucuaccccugcacgagcgaggagaucgaccacgaggacaucaccaaggauaaaacuuccaccgucgaggccugccugcccuuggagcugaccaagaaugaauccugucugaacagcagggagaccucguuuaucaccaauggcagcugccucgccuccaggaagaccagcuucaugauggcccucugucugagcuccaucuaugaggaccugaagauguaccagguggaguucaagaccaugaacgcgaagcugcugauggaccccaagaggcagaucuuccuggaucagaauaugcuggcggugaucgacgagcucaugcaggcccucaauuucaauagcgagacagugccccagaaguccucccuggaggagcccgacuucuacaagaccaagaucaagcuguguauccugcugcacgccuuccggauccgggccgucaccaucgaccgggucaugagcuaccucaaugccagc

SEQ ID NO: 313 - RNA, 1596 nt, Artificial Sequence
  Synthetic: hIL12AB_024 ORF
augugccaccagcagcuggugaucuccugguucucccugguguuccuggccucgccccugguggccaucugggagcugaagaaggacguguacgucguggagcucgacugguaccccgacgccccuggcgagaugguggugcugaccugcgacaccccagaggaggauggcaucaccuggacccuggaucaguccuccgaggugcugggcuccggcaagacgcugaccauccaagugaaggaguucggugacgccggacaguauaccugccauaagggcggcgagguccugucccacagccuccuccuccugcauaagaaggaggacggcaucuggagcaccgacauccugaaggaccagaaggagcccaagaacaagaccuuucugaggugcgaggccaagaacuacagcggccgauucaccugcugguggcucaccaccauauccaccgaccugacuuucuccgucaaguccucccggggguccagcgacccccagggagugaccugcggcgccgccacccucagcgccgagcgggugcggggggacaacaaggaguacgaauacuccgucgagugccaggaggacuccgccugcccggccgccgaggagagccugcccaucgaggugauggucgacgcggugcacaagcugaaguacgagaacuacaccagcaguuucuucaucagggauaucaucaagccagaucccccgaagaaucugcaacugaagccgcugaaaaacucacgacagguggaggugagcugggaguaccccgacacguggagcaccccacauuccuacuucagccugaccuucugcgugcagguccagggcaagagcaagcgggagaagaaggacaggguguucacggauaagaccagugccaccgugaucugcaggaagaacgccucuauuagcgugagggcccaggaucgguauuacuccucgagcuggagcgaaugggccuccgugcccugcagugggggggguggaggcgggagcaggaaccugcccguagcaacccccgaccccgggauguuccccugucugcaccacucgcagaaccugcugcgcgcggugagcaacaugcuccaaaaagcccgucagaccuuagaguucuaccccugcaccagcgaagaaaucgaccacgaagacaucaccaaggacaaaaccagcaccguggaggcgugccugccgcuggagcugaccaagaacgagagcugccucaacuccagggagaccagcuuuaucaccaacggcucgugccuagccagccggaaaaccagcuucaugauggcccugugccugagcuccauuuacgaggaccugaagauguaucagguggaguucaagaccaugaaugccaaacuccugauggaccccaagaggcagaucuuccuggaccagaacaugcucgcggugaucgaugagcugaugcaggcccugaacuuuaauagcgagaccgugccccagaaaagcagccuggaggagccggacuucuacaagaccaaaaucaagcugugcauccugcuccacgccuuccgcauccgggccgugaccaucgacagggugaugagcuaccugaacgccagc

SEQ ID NO: 314 - RNA, 1596 nt, Artificial Sequence
  Synthetic: hIL12AB_025 ORF
augugccaucagcagcuggugauuuccugguucucccugguguuccuggccagcccccucguggcgaucugggagcuaaagaaggacguguacgugguggagcuggacugguacccggacgcacccggcgagauggucguucugaccugcgauacgccagaggaggacggcaucaccuggacccucgaucagagcagcgagguccuggggagcggaaagacccugaccauccaggucaaggaguucggcgacgccggccaguacaccugccacaaagguggcgagguccugagccacucgcugcugcuccugcauaagaaggaggacggaaucuggagcacagacauccugaaagaccagaaggagcccaagaacaagaccuuccugaggugcgaggccaagaacuacagcgggcgcuucacgugcugguggcugaccaccaucagcacggaccucaccuucuccgugaagagcagccggggauccagcgauccccaaggcgucaccugcggcgcggccacccugagcgcggagagggucaggggcgauaauaaggaguaugaguacagcguggagugccaggaggacagcgccugcccggccgccgaggagucccugccaaucgaagugauggucgacgccgugcacaagcugaaguacgagaacuacaccagcagcuucuucauccgggauaucaucaagcccgaucccccgaagaaccugcagcugaagccccucaagaacagccggcagguggaggugaguugggaguaccccgacaccuggucaacgccccacagcuacuucucccugaccuucugugugcaggugcagggaaagagcaagagggagaagaaagaccgggucuucaccgacaagaccagcgccacggugaucugcaggaagaacgcaagcaucuccgugagggcccaggacagguacuacagcuccagcugguccgaaugggccagcgugcccuguagcggcggcgggggcgguggcagccgcaaccucccaguggccacccccgaccccggcauguuccccugccugcaccacagccagaaucugcugagggccgugaguaacaugcugcagaaggcaaggcaaacccucgaauucuaucccugcaccuccgaggagaucgaccacgaggauaucaccaaggacaagaccagcaccgucgaggccugucucccccuggagcugaccaagaaugagagcugccugaacagccgggagaccagcuucaucaccaacgggagcugccuggccuccaggaagaccucguucaugauggcgcugugccucucaagcauauacgaggaucugaagauguaccagguggaguuuaagacgaugaacgccaagcugcugauggacccgaagaggcagaucuuccuggaccagaacaugcuggccgugauagacgagcucaugcaggcccugaacuucaacuccgagaccgugccgcagaagucaucccucgaggagcccgacuucuauaagaccaagaucaagcugugcauccugcuccacgccuuccggauaagggccgugacgaucgacagggugaugagcuaccuuaacgccagc

SEQ ID NO: 315 - RNA, 1596 nt, Artificial Sequence
  Synthetic: hIL12AB_026 ORF
augugccaccagcagcucgugaucagcugguucucccugguguuucucgccagcccccugguggccaucugggagcugaagaaggacguguacgugguggagcuggacugguacccugacgccccgggggagauggucgugcugaccugcgacacccccgaagaggacgguaucaccuggacccuggaccaguccagcgaggugcugggcagcggcaagacccugacuauucaagucaaggaguucggagacgccggccaguacaccugccacaaggguggagagguguuaucacacagccugcugcugcugcacaagaaggaagacgggaucuggagcaccgacauccugaaggaccagaaggagcccaaaaacaagaccuuccugcggugcgaggccaagaacuauucgggccgcuuuacgugcugguggcugaccaccaucagcacugaucucaccuucagcgugaaguccucccgggggucguccgacccccagggggugaccugcggggccgccacccuguccgccgagagagugaggggcgauaauaaggaguacgaguacagcguugagugccaggaagauagcgccugucccgccgccgaggagagccugcccaucgaggugaugguggacgccguccacaagcugaaguaugagaacuacaccucaagcuucuucaucagggacaucaucaaacccgauccgcccaagaaucugcagcugaagccccugaaaaauagcaggcagguggaggugagcugggaguaccccgacaccugguccaccccccauagcuauuucucccugacguucugcgugcaggugcaagggaagagcaagcgggagaagaaggaccggguguucaccgacaagaccuccgccaccgugaucuguaggaagaacgcgucgaucucggucagggcccaggacagguauuacagcagcagcuggagcgagugggcgagcgugcccugcucgggcggcggcggcggcgggagcagaaaucugcccguggccaccccagaccccggaauguuccccugccugcaccauucgcagaaccuccugagggccgugagcaacaugcugcagaaggcccgccagacgcuggaguucuaccccugcacgagcgaggagaucgaccacgaagacaucaccaaggacaaaaccagcaccguggaggccugccugccccuggagcugaccaaaaacgaauccugccucaacagccgggagaccagcuucaucaccaacggcagcugccuggccagccgaaagaccuccuucaugauggcccucugccugagcagcaucuaugaggaucugaagauguaucagguggaguucaagaccaugaaugccaagcugcugauggaccccaagaggcagauauuccuggaccagaauaugcuggccgugaucgacgagcugaugcaggcccugaacuucaacagcgagaccgucccccagaaguccagccuggaggagccggacuuuuacaaaacgaagaucaagcugugcauacugcugcacgccuucaggauccgggccgugacaaucgacagggugauguccuaccugaacgccagc

SEQ ID NO: 316 - RNA, 1596 nt, Artificial Sequence
  Synthetic: hIL12AB_027 ORF
augugucaccagcagcuggugaucagcugguucucccugguguuccuggccagcccccugguggccaucugggagcucaagaaggacgucuacgucguggagcuggauugguaccccgacgcucccggggagaugguggugcugaccugcgacacccccgaggaggacggcaucaccuggacgcuggaccagagcucagaggugcugggaagcggaaagacacugaccauccaggugaaggaguucggggaugccgggcaguauaccugccacaagggcggcgaagugcugagccauucccugcugcugcugcacaagaaggaggacggcauaugguccaccgacauccugaaggaucagaaggagccgaagaauaaaaccuuccugaggugcgaggccaagaauuacagcggccgauucaccugcugguggcugaccaccaucagcaccgaccugaccuucagugugaaguccucacggggcagcucagauccccagggcgugaccugcggggccgcgacacucagcgccgagcgggugaggggugauaacaaggaguacgaguauucuguggagugccaggaagacuccgccugucccgccgccgaggagucccugcccaucgaggugaugguggacgccgugcauaaacugaaguacgagaacuacaccuccagcuucuucauccgggauauaaucaagcccgacccuccgaaaaaccugcagcugaagccccuuaaaaacagccggcagguggaggugagcugggaguaccccgacaccuggagcaccccccauagcuauuucagccugaccuucugcgugcaggugcaggggaaguccaagcgcgagaaaaaggaccggguguucaccgacaagacgagcgccaccgugaucugccggaagaacgccaguauaagcguaagggcccaggauagguacuacagcuccagcuggucggagugggccuccgugcccuguuccggcggcgggggggguggcagcaggaaccuccccguggccacgccggaccccggcauguucccgugccugcaccacucccaaaaccuccugcgggccgucagcaacaugcugcaaaaggcgcggcagacccuggaguuuuaccccuguaccuccgaagagaucgaccacgaggauaucaccaaggauaagaccuccaccguggaggccugucucccccuggagcugaccaagaacgagagcugucuuaacagcagagagaccucguucauaacgaacggcuccugccucgcuuccaggaagacgucguucaugauggcgcugugccuguccagcaucuacgaggaccugaagauguaucaggucgaguucaaaaccaugaacgccaagcugcugauggaccccaagaggcagaucuuccuggaccagaacaugcucgccgugaucgacgagcugaugcaggcccugaacuucaacagcgaaaccgugccccagaagucaagccuggaggagccggacuucuauaagaccaagaucaagcuguguauccugcuacacgcuuuucguauccgggccgugaccaucgacaggguuaugucguacuugaacgccagc

SEQ ID NO: 317 - RNA, 1596 nt, Artificial Sequence
  Synthetic: hIL12AB_028 ORF
augugccaccaacagcucgugaucagcugguucagccugguguuccuggccagcccgcugguggccaucugggagcugaagaaggacguguacgugguggagcuggacugguaccccgacgcccccggcgagauggugguccugaccugcgacacgccggaagaggacggcaucaccuggacccuggaucaguccagcgaggugcugggcuccggcaagacccugaccauucaggugaaggaguucggcgacgccggucaguacaccugccacaagggcggcgaggugcugagccacagccuacugcuccugcacaaaaaggaggauggaaucugguccaccgacauccucaaggaccagaaggagccgaagaacaagacguuccuccggugcgaggccaagaacuacagcggcagguuuaccugcugguggcugaccaccaucagcaccgaccugacauuuuccgugaagagcagccgcggcagcagcgauccccagggcgugaccugcggggcggccacccuguccgccgagcgugugaggggcgacaacaaggaguacgaguacagcguggaaugccaggaggacagcgccugucccgccgccgaggagagccugccaaucgaggucaugguggacgccgugcacaagcugaaguacgagaacuacacgagcagcuucuucaucagggacaucaucaaaccggacccgcccaagaaccugcagcugaaacccuugaaaaacagcaggcagguggaagugucuugggaguaccccgacaccugguccaccccccacagcuacuuuagccugaccuucugugugcagguccagggcaaguccaagagggagaagaaggacaggguguucaccgacaaaaccagcgccaccgugaucugcaggaagaacgccuccaucagcgugcgggcccaggacagguauuacagcucgucguggagcgagugggccagcgugcccugcuccgggggaggcggcggcggaagccggaaucugcccguggccacccccgaucccggcauguucccgugucugcaccacagccagaaccugcugcgggccgugagcaacaugcugcagaaggcccgccaaacccuggaguucuaccccuguacaagcgaggagaucgaccaugaggacauuaccaaggacaagaccagcaccguggaggccugccugccccucgagcucacaaagaacgaauccugccugaauagccgcgagaccagcuuuaucacgaacggguccugccucgccagccggaagacaagcuucaugauggcccugugccugagcagcaucuacgaggaccugaaaauguaccaaguggaguucaaaacgaugaacgccaagcugcugauggaccccaagcgccagaucuuccuggaccagaacaugcuggccgucaucgacgagcucaugcaggcccugaacuucaacagcgagaccgugccccagaagagcagccuggaggagcccgacuucuacaagacgaagaucaagcucugcauccugcugcacgcuuuccgcauccgcgcggugaccaucgaccgggugaugagcuaccucaacgccagu

SEQ ID NO: 318 - RNA, 1596 nt, Artificial Sequence
  Synthetic: hIL12AB_029 ORF
augugccaccaacagcuggugaucagcugguucagccugguguuucuggccuccccucugguggccaucugggagcugaagaaggacguguacgugguggagcuggacugguacccugacgcccccggcgaaaugguggugcugacgugcgacacccccgaggaggauggcaucaccuggacccuggaccaaagcagcgagguccucggaagcggcaagacccucacuauccaagugaaggaguucggggaugcgggccaguacaccugccacaagggcggcgaggugcugucucauagccugcugcuccugcauaagaaggaagacggcaucuggagcaccgacauacugaaggaucagaaggagcccaagaacaagaccuuccugaggugcgaggccaagaacuacuccgggcgcuucaccuguugguggcugaccaccaucuccaccgaccugaccuucagcgugaagagcagcagggggagcagcgacccccagggggugaccugcggagccgcgaccuugucggccgagcgggugaggggcgacaauaaggaguacgaguacucggucgaaugccaggaggacuccgccugccccgccgccgaggagucccuccccaucgaagugaugguggacgccguccacaagcugaaguacgagaacuacaccagcagcuucuucauacgggauaucaucaagcccgaccccccgaagaaccugcagcugaaacccuugaagaacuccaggcagguggaggugagcugggaguaccccgacaccugguccaccccgcacucauacuucagccugaccuucuguguacagguccagggcaagagcaagagggaaaagaaggauaggguguucaccgacaagaccuccgccacggugaucugucggaaaaacgccagcaucuccgugcgggcccaggacagguacuauuccagcagcuggagcgagugggccuccguccccugcuccggcggcgguggcgggggcagcaggaaccuccccguggccacccccgaucccgggauguucccaugccugcaccacagccaaaaccugcugagggccgucuccaauaugcugcagaaggcgaggcagacccuggaguucuaccccuguaccuccgaggagaucgaccacgaggauaucaccaaggacaagaccuccacggucgaggcgugccugccccuggagcucacgaagaacgagagcugccuuaacuccagggaaaccucguuuaucacgaacggcagcugccuggcgucacggaagaccuccuuuaugauggcccuaugucuguccucgaucuacgaggaccugaagauguaccagguggaguucaagaccaugaacgccaagcugcugauggaucccaagaggcagauuuuccuggaccagaacaugcuggccgugauugacgagcugaugcaggcgcugaacuucaacagcgagacagugccgcagaagagcucccuggaggagccggacuuuuacaagaccaagauaaagcugugcauccugcuccacgccuucagaauacgggccgucaccaucgauagggugaugucuuaccugaacgccucc

SEQ ID NO: 319 - RNA, 1596 nt, Artificial Sequence
  Synthetic: hIL12AB_030 ORF
augugccaccagcagcuggugauuagcugguuuagccugguguuccuggcaagcccccugguggccaucugggaacugaaaaaggacguguacguggucgagcuggauugguaccccgacgcccccggcgaaaugguggugcugacgugugauacccccgaggaggacgggaucaccuggacccuggaucagagcagcgaggugcuggggagcgggaagacccugacgauccaggucaaggaguucggcgacgcugggcaguacaccugucacaagggcggggaggugcugucccacucccugcugcuccugcauaagaaagaggacggcaucugguccaccgacauccucaaggaccagaaggagcccaagaacaagaccuuccugcggugugaggcgaagaacuacagcggccguuucaccugcugguggcugacgacaaucagcaccgacuugacguucuccgugaaguccuccagaggcagcuccgacccccaaggggugacgugcggcgcggccacccugagcgccgagcgggugcggggggacaacaaggaguacgaguacuccguggagugccaggaggacagcgccugucccgcagccgaggagucccugcccaucgaagucaugguggacgccguccacaagcugaaguacgagaacuacaccagcagcuucuucauccgcgauaucaucaagcccgauccccccaaaaaccugcaacugaagccgcugaagaauagcaggcagguggagguguccugggaguacccggacaccuggagcacgccccacagcuauuucagccugaccuuuugcgugcagguccaggggaagagcaagcgggagaagaaggaccgcguguuuacggacaaaaccagcgccaccgugaucugcaggaagaacgccagcaucagcgugagggcccaggacagguacuacagcagcuccuggagcgagugggccuccgugcccuguuccggaggcggcgggggcgguucccggaaccucccgguggccacccccgacccgggcauguucccgugccugcaccacucacagaaucugcugagggccgugagcaauaugcugcagaaggcaaggcagacccuggaguuuuaucccugcaccagcgaggagaucgaccacgaagacaucaccaaggacaagaccagcacaguggaggccugccugccccuggaacugaccaagaacgaguccugucugaacucccgggaaaccagcuucauaaccaacggcuccugucucgccagcaggaagaccagcuucaugauggcccugugccucagcuccaucuacgaggaccucaagauguaccagguugaguucaagaccaugaacgccaagcuccugauggaccccaagaggcagaucuuccuggaccagaauaugcuggccgugaucgaugaguuaaugcaggcgcugaacuucaacagcgagacggugccccaaaaguccucgcuggaggagcccgacuucuacaagaccaagaucaagcugugcauccuccugcacgccuuccgaauccgggccguaaccaucgacagggugaugagcuaucucaacgccucc

SEQ ID NO: 320 - RNA, 1596 nt, Artificial Sequence
  Synthetic: hIL12AB_031 ORF
augugccaccagcagcucgugaucagcugguucucgcuuguguuccuggccuccccccucgucgccaucugggagcugaagaaagacguguacgugguggagcuggacugguaucccgacgccccgggggagaugguggugcugaccugcgacaccccggaagaggacggcaucaccuggacgcucgaccagucguccgaagugcuggggucgggcaagacccucaccauccaggugaaggaguucggagacgccggccaguacaccugucauaaggggggggaggugcugagccacagccuccugcuccugcacaaaaaggaggacggcaucuggagcaccgauauccucaaggaccagaaggagcccaagaacaagacguuccugaggugugaggccaagaacuacagcgggcgguucacguguugguggcucaccaccaucuccaccgaccucaccuucuccgugaagucaagcaggggcagcuccgacccccaaggcgucaccugcggcgccgccacccugagcgccgagagggucaggggggauaacaaggaauacgaguacaguguggagugccaagaggauagcgccugucccgccgccgaagagagccugcccaucgaagugaugguggacgccgugcacaagcugaaguacgagaacuacaccuccagcuucuucaucagggauaucaucaagcccgauccccccaagaaccugcagcugaagccccugaagaacagcaggcagguggaggugagcugggaguaucccgacacguggagcaccccgcacagcuacuucucgcugaccuucugcgugcaggugcaagggaaguccaagagggagaagaaggauaggguguucaccgacaaaacgagcgccaccgugaucugccggaagaaugccagcaucucugugagggcccaggacagguacuauuccagcuccuggucggagugggccagcgugcccuguagcggcgggggcgggggcggcagcaggaaccucccgguugccacccccgaccccggcauguuuccgugccugcaccacucgcaaaaccugcugcgcgcggucuccaacaugcugcaaaaagcgcgccagacgcuggaguucuaccccugcaccagcgaggagaucgaucaugaagauaucaccaaagacaagaccucgaccguggaggccugccugccccuggagcucaccaagaacgaaagcugccugaacagcagggagacaagcuucaucaccaacggcagcugccuggccucccggaagaccagcuucaugauggcccugugccuguccagcaucuacgaggaucugaagauguaccaaguggaguuuaagaccaugaacgccaagcuguuaauggaccccaaaaggcagaucuuccuggaucagaacaugcuggccgucaucgacgagcugaugcaagcccugaacuucaacagcgagacggugccccagaagagcagccucgaggagcccgacuucuauaagaccaagauaaagcugugcauucugcugcacgccuucagaaucagggccgugaccaucgauagggugaugagcuaccugaacgccagc

SEQ ID NO: 321 - RNA, 1596 nt, Artificial Sequence
  Synthetic: hIL12AB_032 ORF
augugucaccagcagcuggugauuuccugguucagucugguguuucuugccagcccccugguggccaucugggagcugaagaaagacguauacgucguggagcuggacugguaucccgacgcucccggcgagauggugguccucaccugcgacaccccagaggaggacggcaucaccuggacccuggaccagagcuccgagguccugggcagcgguaagacccucaccauccaggugaaggaguuuggugaugccgggcaguauaccugccacaagggcggcgaggugcugucccacagccuccuguuacugcauaagaaggaggauggcaucuggagcaccgacauccucaaggaccagaaagagcccaagaacaagaccuuucugcggugcgaggcgaaaaauuacuccggccgguucaccugcugguggcugaccaccaucagcacggaccugacguucuccgugaagucgagcagggggagcuccgauccccagggcgugaccugcggcgcggccacccugagcgccgagcgcguccgcggggacaauaaggaauacgaauauagcguggagugccaggaggacagcgccugccccgcggccgaggagagccucccgaucgaggugaugguggaugccguccacaagcucaaauacgaaaacuacaccagcagcuucuucauuagggacaucaucaagcccgacccccccaaaaaccugcagcugaagccccugaagaacagccgccaggucgaggugucaugggaguacccagacaccuggagcaccccccacuccuacuucagccugaccuucugcguccaggugcagggaaaguccaaacgggagaagaaggauagggucuuuaccgauaagacgucggccaccgucaucugcaggaagaacgccagcauaagcgugcgggcgcaggaucgguacuacagcucgagcugguccgaaugggccuccgugcccuguagcggaggggguggcgggggcagcaggaaccugcccguggccaccccggacccgggcauguuucccugccugcaucacagucagaaccugcugagggccgugagcaacaugcuccagaaggcccgccagacccuggaguuuuaccccugcaccagcgaagagaucgaucacgaagacaucaccaaagacaagaccuccaccguggaggccugucugccccuggagcugaccaagaacgagagcugucugaacagcagggagaccuccuucaucaccaacggcuccugccuggcaucccggaagaccagcuucaugauggcccugugucugagcucuaucuacgaggaccugaagauguaccaggucgaguucaagaccaugaacgccaagcugcugauggaccccaagcgacagauauuccuggaccagaacaugcucgccgugaucgaugaacugaugcaagcccugaacuucaauagcgagaccgugccccagaaaagcagccuggaggagcccgacuucuacaagaccaagaucaaacugugcauacugcugcacgcguucaggauccgggccgucaccaucgaccgggugauguccuaucugaaugccagc

SEQ ID NO: 322 - RNA, 1596 nt, Artificial Sequence
  Synthetic: hIL12AB_033 ORF
augugccaccagcagcucgugauuagcugguuuucgcugguguuccuggccagcccucucguggccaucugggagcugaaaaaagacguguacgugguggagcuggacugguacccggacgcccccggcgagaugguggugcugacgugcgacaccccggaagaggacggcaucaccuggacccuggaccagucauccgagguccugggcagcggcaagacgcucaccauccaggugaaggaguucggcgacgccggccaguacacaugccauaagggcggggaggugcugagccacagccugcuccuccugcacaagaaggaggauggcaucuggucuacagacauccugaaggaccagaaagagcccaagaacaagaccuuccuccggugcgaggccaagaacuacuccgggcgguuuacuuguugguggcugaccaccaucagcaccgaccucaccuucagcgugaagagcucccgagggagcuccgacccccagggggucaccugcggcgccgccacccugagcgccgagcgggugaggggcgacaacaaggaguaugaauacagcguggaaugccaagaggacagcgccugucccgcggccgaggaaagccugcccaucgaggugaugguggacgccguccacaaacucaaguacgagaacuacaccagcaguuucuucauucgcgacaucaucaagccggacccccccaaaaaccugcagcucaaaccccugaagaacagcaggcagguggaggucagcugggaguacccggacaccuggagcaccccccauagcuacuucagccugaccuucugcgugcaggugcagggcaagagcaaacgcgagaagaaggaccggguguuuaccgacaagaccagcgccacggugaucugccgaaagaaugcaagcaucuccgugagggcgcaggaccgcuacuacucuagcagcuggagcgagugggccagcgugcccugcagcgguggcggcggaggcggcagccguaaccuccccguggccacccccgaccccggcauguucccgugucugcaccacucccagaaccugcugagggccgucagcaauaugcugcagaaggcccggcagacgcuggaguucuaccccugcaccuccgaggagaucgaccaugaggacauuaccaaggacaagacgagcacuguggaggccugccugccccuggagcucaccaaaaacgagagcugccugaauagcagggagacguccuucaucaccaacggcagcugucuggccagcaggaagaccagcuucaugauggcccugugccucuccuccauauaugaggaucugaagauguaccagguggaguucaagaccaugaacgccaagcugcugauggaucccaagaggcagaucuuccuggaccagaauaugcuggccgugauugacgagcugaugcaggcccugaacuuuaauagcgagaccgucccccagaagagcagccuggaggagcccgacuucuauaagaccaagaucaagcugugcauacugcugcacgcguuuaggauaagggccgucaccaucgacagggugaugagcuaccugaaugccagc

SEQ ID NO: 323 - RNA, 1596 nt, Artificial Sequence
  Synthetic: hIL12AB_034 ORF
augugccaccaacagcuggugaucuccugguucagccugguguuccucgccagcccccugguggccaucugggagcugaagaaagacguguacgugguggagcuggacugguaucccgacgcccccggcgagauggucgugcugaccugcgacaccccggaggaggacggcaucaccuggacccuggaucaguccuccgaggugcugggcagcgggaagacccugaccauccaggugaaagaguucggagaugccggccaguauaccugucacaaggggggugaggugcugagccauagccucuugcuucugcacaagaaggaggacggcaucugguccaccgacauccucaaggaccaaaaggagccgaagaauaaaacguuccugaggugcgaagccaagaacuauuccggacgguucaccugcugguggcugaccaccaucagcaccgaccucaccuucuccguaaagucaagcaggggcagcuccgacccccagggcgugaccugcggagccgccacccugagcgcagagagggugaggggcgacaacaaggaguacgaauacuccgucgagugccaggaggacagcgccugccccgccgccgaggaaagucugcccaucgaggugaugguggacgccgugcacaagcucaaauacgagaacuacaccagcagcuucuucauccgggauaucaucaagcccgacccuccaaagaaucugcagcugaaaccccuuaagaacagcaggcagguggaggucagcugggaguaccccgacaccuggagcacgccccacuccuacuuuagccugaccuuuugcgugcaggugcaggggaaaagcaagcgggagaagaaggacaggguguucaccgauaagaccuccgcuaccgugaucugcaggaagaacgccucaaucagcgugagggcccaggaucgguacuacuccagcuccuggagcgagugggccagcgugcccugcucuggcgguggcggcgggggcagccggaaccugccgguggccacucccgacccgggcauguucccgugccuccaccauucccagaaccugcugcgggccguguccaauaugcuccagaaggcaaggcagacccuggaguucuaccccugcaccagcgaggagaucgaucacgaggacaucaccaaagacaaaaccagcacggucgaggccugccugccccuggaacucaccaagaacgaaagcugucucaacagccgcgagaccagcuucauaaccaacgguuccugucuggccucccgcaagaccagcuuuaugauggcccucugucugagcuccaucuaugaagaccugaaaauguaccagguggaguucaaaaccaugaacgccaagcuucugauggaccccaagaggcagaucuuccuggaucagaacaugcuggccgugaucgacgagcugaugcaggcccugaacuuuaacuccgagaccgugccccagaaaagcagccuggaagagcccgauuucuacaaaacgaagaucaagcugugcauccugcugcacgccuuccggauccgugcggugaccaucgauagggugaugagcuaccugaacgccagc

SEQ ID NO: 324 - RNA, 1596 nt, Artificial Sequence
  Synthetic: hIL12AB_035 ORF
augugccaccaacagcugguaaucagcugguucagccugguuuuccucgcgucgccccugguggccaucugggaguuaaagaaggacguguacgugguggagcuggauugguaccccgacgccccgggcgagauggucgugcucaccugcgauacccccgaggaggacgggaucaccuggacccuggaccaauccagcgaggugcugggcagcggcaagacccugaccauacaggugaaggaauuuggggacgccgggcaguacaccugccacaagggcggggaagugcugucccacucccuccugcugcugcauaagaaggaggacggcaucuggagcaccgacauccugaaggaccaaaaggagcccaagaacaagaccuuccugaggugcgaggccaaaaacuauuccggccgcuuuaccuguugguggcugaccaccaucuccaccgaucugaccuucagcgugaagucgucuaggggcuccuccgacccccagggcguaaccugcggcgccgcgacccugagcgccgagagggugcggggcgauaacaaagaguacgaguacucgguggagugccaggaggacagcgccuguccggcggccgaggagagccugcccaucgaggugaugguggacgccguccacaagcugaaguacgagaacuacaccaguucguucuucaucagggacaucaucaagccggacccccccaagaaccuccagcugaagccccugaagaacagcaggcagguggaaguguccugggaguaucccgacaccuggagcaccccccacagcuacuucagccugaccuuuugcgugcaggugcagggcaaaagcaagagggaaaagaaggaccggguguucaccgauaagacgagcgccaccguuaucugcaggaagaacgccuccauaagcgugagggcgcaggaccguuacuacagcagcagcuggagugagugggcaagcgugcccuguagcggcgggggcgggggcgggucccgcaaccuccccgucgccacccccgacccaggcauguuuccgugccugcaccacagccagaaccugcugcgggccguuagcaacaugcugcagaaggccaggcagacccucgaguucuaucccugcacaucugaggagaucgaccacgaagacaucacuaaggauaagaccuccaccguggaggccugucugccccucgagcugaccaagaaugaauccugccugaacagccgagagaccagcuuuaucaccaacggcuccugccuggccagcaggaagaccuccuucaugauggcccugugccucuccagcaucuacgaggaucugaagauguaccagguagaguucaagacgaugaacgccaagcuccugauggaccccaagaggcagauauuccuggaccagaacaugcuggcggugaucgacgagcugaugcaggcccugaauuucaacagcgagacggugccacagaaguccagccuggaggagccagacuucuacaagaccaagaucaaacugugcauccuccugcacgcguucaggauccgcgccgucaccauagacagggugaugaguuaucugaacgccagc

SEQ ID NO: 325 - RNA, 1596 nt, Artificial Sequence
  Synthetic: hIL12AB_036 ORF
augugccaucagcagcugguaaucagcugguuuagccugguguuccuggccagcccacugguggccaucugggagcugaagaaggacguguacgugguggaacuggacugguaccccgacgccccuggcgagauggugguacugaccugugacaccccggaggaagacgguaucaccuggacccuggaucagagcuccgaggugcugggcuccggcaagacacugaccauccaaguuaaggaauuuggggacgccggccaguacaccugccacaaggggggcgaggugcugucccacucccugcugcuucugcauaagaaggaggauggcaucugguccaccgacauacugaaggaccagaaggagcccaagaauaagaccuuccugagaugcgaggccaagaacuacucgggaagguucaccugcugguggcugaccaccaucagcaccgaccugaccuucuccgugaagagcucccggggcagcuccgacccccagggcguaaccuguggggccgcuacccuguccgccgagaggguccggggcgacaacaaggaauacgaguacagcguggagugccaggaggacuccgccugccccgccgccgaggagucgcugcccauagaggugaugguggacgccgugcacaagcucaaguacgagaauuacaccagcagcuucuuuaucagggacauaauuaagccggaccccccaaagaaucugcagcugaagccccugaagaauagccggcagguggaaguguccugggaguaccccgacaccuggagcaccccccacuccuauuucucacugacauucugcgugcaggugcaagggaaaagcaagagggagaagaaggauaggguguucaccgacaagacaagcgccaccgugaucugccgaaaaaaugccagcaucagcgugagggcccaggaucgguauuacagcagcuccuggagcgagugggccagcgugcccuguuccggcgggggagggggcggcucccggaaccugccgguggccacccccgacccuggcauguuccccugccugcaucacagccagaaccugcuccgggccgugucgaacaugcugcagaaggcccggcagacccucgaguuuuaccccugcaccagcgaagagaucgaccacgaagacauaaccaaggacaagaccagcacgguggaggccugccugccccuggagcuuaccaaaaacgaguccugccugaacagccgggaaaccagcuucauaacgaacgggagcugccuggccuccaggaagaccagcuucaugauggcgcugugucuguccagcauauacgaggaucugaagauguaucagguggaauucaaaacuaugaaugccaagcuccugauggaccccaagaggcagaucuuccuggaccagaacaugcuagccgugaucgacgagcugaugcaggcccucaacuucaacucggagacggugccccagaaguccagccucgaggagcccgacuucuacaagaccaagaucaagcugugcauacugcugcaugccuucaggauaagggcggugacuaucgacagggucauguccuaccugaacgccagc

SEQ ID NO: 326 - RNA, 1596 nt, Artificial Sequence
  Synthetic: hIL12AB_037 ORF
augugccaccaacaacuggugaucagcugguucucccugguguuccuggccagcccccugguggccaucugggagcucaaaaaagacguguacgugguggagcucgauugguacccagacgcgccgggggaaaugguggugcugaccugcgacaccccagaggaggauggcaucacguggacgcuggaucaguccagcgaggugcuggggagcggcaagacgcucaccauccaggugaaggaauuuggcgacgcgggccaguauaccugucacaagggcggcgaggugcugagccacucccugcugcugcugcacaagaaggaggaugggaucuggucaaccgauauccugaaagaccagaaggagcccaagaacaagaccuuccugcgcugcgaggccaagaacuauagcggcagguucaccugcugguggcugaccaccaucagcaccgaccugaccuucagcgugaaauccuccaggggcagcagcgacccccagggcgugaccugcggugccgccacgcucuccgccgagcgagugaggggugacaacaaggaguacgaguacagcguggaaugucaggaggacagcgccugucccgccgccgaggagucgcugcccaucgaggugauggucgacgcggugcacaagcucaaauacgagaauuacaccagcagcuucuucaucagggacaucaucaagcccgacccccccaagaaccugcagcugaagcccuugaagaacagcaggcagguggaggugagcugggaguacccggacaccuggagcaccccccacuccuacuucagccugacguucugugugcaggugcaggggaaguccaagagggagaagaaggaccggguguucaccgacaagaccagcgccaccgugauaugccgcaagaacgcguccaucagcguucgcgcccaggaccgcuacuacagcagcuccugguccgaaugggccagcgugcccugcagcgguggagggggcgggggcuccaggaaucugccgguggccacccccgaccccgggauguucccgugucugcaucacucccagaaccugcugcgggccgugagcaauaugcugcagaaggccaggcagacgcucgaguucuaccccugcaccuccgaagagaucgaccaugaggacaucaccaaggacaagaccagcaccguggaggccugccucccccuggagcugaccaaaaacgagagcugccugaacuccagggagaccagcuuuauaaccaacggcagcugccucgccuccaggaagaccucguuuaugauggcccucugccuguccagcaucuacgaggaccugaagauguaccagguggaguucaagaccaugaacgcgaaguugcucauggaccccaagaggcagaucuuccuggaccagaacaugcucgcggugaucgacgagcugaugcaagcccugaacuucaacagcgagaccgugccccagaagagcagccuggaagagcccgacuucuacaagaccaagaucaagcugugcauccugcugcacgccuuccggauccgggccgugaccaucgacagggugaugagcuaccucaacgccucc

SEQ ID NO: 327 - RNA, 1596 nt, Artificial Sequence
  Synthetic: hIL12AB_038 ORF
augugccaccagcagcucgugaucagcugguucucccucgucuuccuggccuccccgcugguggccaucugggagcugaagaaggacguguacgugguggagcuggacugguaucccgacgcccccggcgagaugguggugcugacgugcgacacaccagaagaggacgggaucacauggacccuggaucagucguccgaggugcuggggagcggcaagacccucaccauccaagugaaggaguucggggacgccggccaguacaccugccacaagggcggggaggugcucucccauagccugcuccuccugcacaaaaaggaggauggcaucuggagcaccgacauccugaaggaccagaaggagcccaagaacaagacauuucucaggugugaggccaagaacuauucgggcagguuuaccuguugguggcucaccaccaucucuaccgaccugacguucuccgucaagucaagcagggggagcucggacccccagggggugacauguggggccgccacccugagcgcggagcguguccgcggcgacaacaaggaguacgaguauuccguggagugccaggaggacagcgccugccccgccgccgaggagucccugcccauagaggugaugguggacgccguccacaaguugaaguacgaaaauuauaccuccucguucuucauuagggacaucaucaagccugaccccccgaagaaccuacaacucaagccccucaagaacucccgccagguggagguguccugggaguaccccgacaccugguccaccccgcacagcuacuucagccugaccuucugcgugcagguccaggggaagagcaagcgugaaaagaaagacaggguguucaccgacaagacgagcgccaccgugaucugcaggaaaaacgccuccaucuccgugcgcgcccaggacagguacuacaguagcuccuggagcgaaugggccagcgugccgugcagcggcgggggaggaggcggcagucgcaaccugcccguggccacccccgaccccggcauguucccaugccugcaccacagccagaaccugcugagggcagucagcaauaugcugcagaaggccaggcagacccuggaguuuuaucccugcaccagcgaggagaucgaccacgaggacaucaccaaggacaagaccuccaccgucgaggccugccugccacuggagcugaccaaaaacgagagcugccugaacuccagggagaccuccuucaucaccaacgggagcugccuggccagccggaagaccagcuucaugauggcgcugugccucagcagcaucuacgaggaucucaagauguaccagguggaguucaagaccaugaacgcgaagcugcugauggaccccaagcggcagaucuuccuggaccagaacaugcuggccgugauugacgagcucaugcaggcccugaacuucaauagcgagaccgucccccaaaagagcagccuggaggaacccgacuucuacaaaacgaagaucaagcucugcauccugcugcacgccuuccggauccgggccgugaccaucgaucgugugaugagcuaccugaacgccucg

SEQ ID NO: 328 - RNA, 1596 nt, Artificial Sequence
  Synthetic: hIL12AB_039 ORF
augugccaccagcagcucgucaucuccugguuuagccugguguuucuggccuccccccuggucgccaucugggagcugaagaaagacguguacgugguggagcuggacugguacccggacgcucccggggagaugguggugcugaccugcgacacccccgaggaggacggcaucaccuggacccuggaccagagcuccgaggugcuggggagcggcaagacccugaccauucaggugaaagaguucggcgacgccggccaauauaccugccacaaggggggggagguccugucgcauucccugcugcugcuucacaaaaaggaggauggcaucuggagcaccgacauccugaaggaccagaaagaacccaagaacaagacguuccugcgcugcgaggccaagaacuacagcggccgguucaccuguugguggcugaccaccaucuccaccgaccugacuuucucggugaagagcagccgcgggagcagcgacccccagggagugaccugcggcgccgccacccugagcgccgaaagggugaggggcgacaauaaagaguacgaguauuccguggagugccaggaggacagcgccugucccgccgccgaggagucccugccuaucgaggugauggucgacgcggugcacaagcucaaguacgaaaacuacaccagcagcuuuuucaucagggauaucaucaaaccagacccccccaagaaccugcagcugaagccccugaaaaacagcaggcagguggaagugagcugggaauaccccgauaccugguccaccccccacagcuacuucagccugaccuucugcgugcaggugcaggggaaguccaagcgggagaagaaagaucggguguucacggacaagaccagcgccaccgugauuugcaggaaaaacgccagcaucuccgugagggcucaggacagguacuacagcuccagcuggagcgagugggccuccgugccuugcagcgggggaggaggcggcggcagcaggaaucugcccgucgcaacccccgaccccggcauguuccccugccugcaccacagccagaaucugcugcgagccgugagcaacaugcuccagaaggcccggcagacgcuggaguucuaccccugcaccuccgaggagaucgaccacgaggacaucaccaaggauaagacgagcaccgucgaggccugucucccccuggagcucaccaagaacgaguccugccugaauagcagggagacguccuucauaaccaacggcagcugucuggcguccaggaagaccagcuucaugauggcccucugccugagcuccaucuacgaggaccucaagauguaccaggucgaguucaagaccaugaacgcaaaacugcucauggauccaaagaggcagaucuuucuggaccagaacaugcuggccgugaucgaugaacucaugcaggcccugaauuucaauuccgagaccgugccccagaagagcucccuggaggaacccgacuucuacaaaacaaagaucaagcuguguauccuccugcacgccuuccggaucagggccgucaccauugaccgggugauguccuaccugaacgccagc

SEQ ID NO: 329 - RNA, 1596 nt, Artificial Sequence
  Synthetic: hIL12AB_040 ORF
augugccaucagcagcuggugaucagcugguucagccucguguuccucgccagcccccucguggccaucugggagcugaaaaaggacguguacgugguggagcuggacugguaucccgacgccccgggcgagaugguggugcugaccugcgacacccccgaggaggacggcauuaccuggacacuggaccagagcagcgagguccugggcagcgggaagacccugacaauucaggugaaggaguucggcgacgccggacaguacacgugccacaaggggggggaggugcugucccacagccuccuccugcugcacaagaaggaggauggcaucuggagcaccgacauccugaaggaucagaaggagcccaagaacaagaccuuucugagaugcgaggccaagaauuacagcggccguuucaccugcugguggcucaccaccaucagcaccgaccugaccuucagcgugaaauccuccaggggcuccuccgacccgcagggagugaccugcggcgccgccacacugagcgccgagcgggucagaggggacaacaaggaguacgaguacagcguugagugccaggaggacagcgccugucccgcggccgaggaaucccugcccaucgaggugaugguggacgcagugcacaagcugaaguacgagaacuauaccucgagcuucuucauccgggauaucauuaagcccgaucccccgaagaaccugcagcucaaaccccugaagaacagcaggcagguggaggucuccugggaguaccccgacacaugguccaccccccauuccuauuucucccugaccuuuugcgugcaggugcagggcaagagcaagagggagaaaaaggacaggguguucaccgacaagaccuccgccaccgugaucugccguaagaacgcuagcaucagcgucagggcccaggacagguacuauagcagcuccugguccgagugggccagcgucccgugcagcggcgggggcgguggaggcucccggaaccuccccguggccaccccggaccccgggauguuucccugccugcaucacagccagaaccugcugagggccguguccaacaugcugcagaaggccaggcagacacucgaguuuuaccccugcaccagcgaggagaucgaccacgaagacaucaccaaggacaagaccuccaccguggaggcaugccugccccuggagcugaccaaaaacgaaagcugucugaacuccagggagaccuccuuuaucacgaacggcucaugccuggccuccagaaagaccagcuucaugauggcccugugccugagcuccaucuacgaggacuugaaaauguaccaggucgaguucaagaccaugaacgccaagcugcucauggaccccaaaaggcagaucuuucuggaccagaauaugcuggccgugaucgacgagcucaugcaagcccugaauuucaacagcgagaccgugccccagaaguccucccuggaggagcccgacuucuacaagaccaagaucaagcugugcauacuccugcacgcguuuaggaucagggcggugaccaucgauagggugaugagcuaccugaaugccucc

SEQ ID NO: 330 - RNA, 66 nt, Artificial Sequence
  Synthetic: Wild Type IL12B signal peptide Nucleic acids
augugucaccagcaguuggucaucucuugguuuucccugguuuuucuggcaucuccccucguggcc

SEQ ID NO: 331 - RNA, 18 nt, Artificial Sequence
  Synthetic: Syn 5 promoter
auugggcacccguaaggg

SEQ ID NO: 332 - RNA, 1829 nt, Artificial Sequence
  Synthetic: hIL12AB_001 (5UTR ORF  3UTR)
ucaagcuuuuggacccucguacagaagcuaauacgacucacuauagggaaauaagagagaaaagaagaguaagaagaaauauaagagccaccaugugucaccagcagcuggucauuagcugguuuagccuuguguuccuggccuccccccuugucgcuauuugggagcucaagaaggacguguacgugguggaguuggauugguacccagacgcgcccggagagaugguaguucugaccugugauaccccagaggaggacggcaucaccuggacgcuggaccaaagcagcgagguuuugggcucagggaaaacgcugaccauccaggugaaggaauucggcgacgccgggcaguacaccugccauaagggaggagaggugcugagccauucccuucuucugcugcacaagaaagaggacggcaucuggucuaccgacauccugaaagaccagaaggagcccaagaacaaaaccuuccugaggugcgaggccaagaacuacuccggcagguucacuuguugguggcugaccaccaucaguacagaccugacuuuuaguguaaaaagcuccagaggcucguccgauccccaaggggugaccugcggcgcagccacucugagcgcugagcgcgugcgcggugacaauaaagaguacgaguacagcguugagugucaagaagauagcgcuugcccugccgccgaggagagccugccuaucgaggugaugguugacgcagugcacaagcuuaaguacgagaauuacaccagcucauucuucauuagagauauaaucaagccugacccacccaagaaccugcagcugaagccacugaaaaacucacggcaggucgaagugagcugggaguaccccgacaccuggagcacuccucauuccuauuucucucuuacauucugcguccaggugcagggcaagagcaagcgggaaaagaaggaucgagucuucaccgacaaaacaagcgcgaccgugauuugcaggaagaacgccagcaucuccgucagagcccaggauagauacuauaguagcagcuggagcgagugggcaagcgugcccuguuccggcggcgggggcgggggcagccgaaacuugccugucgcuaccccggacccuggaauguuuccgugucugcaccacagccagaaccugcugagagccgugucgaauaugcuccagaaggcccggcagacccuugaguucuaccccuguaccagcgaagagaucgaucaugaagauaucacgaaagauaaaacauccaccgucgaggcuugucucccgcuggagcugaccaagaacgagagcugucugaauagccgggagacgucuuucaucacgaaugguagcugucuggccagcaggaaaacuuccuucaugauggcucucugccugagcucuaucuaugaagaucugaagauguaucagguggaguuuaaaacaaugaacgccaaacuccugauggacccaaaaaggcaaaucuuucuggaccagaauaugcuggccgugauagacgagcugaugcaggcacugaacuucaacagcgagacggugccacagaaauccagccuggaggagccugacuuuuacaaaacuaagaucaagcuguguauccugcugcacgccuuuagaauccgugccgugacuaucgacagggugaugucauaccucaacgcuucaugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 333 - RNA, 1829 nt, Artificial Sequence
  Synthetic: hIL12AB_002 (5UTR ORF  3UTR)
ucaagcuuuuggacccucguacagaagcuaauacgacucacuauagggaaauaagagagaaaagaagaguaagaagaaauauaagagccaccaugugccaccagcagcuggugaucagcugguucagccugguguuccuggccagcccccugguggccaucugggagcugaagaaggacguguacgugguggaguuggauugguaccccgacgcccccggcgagaugguggugcugaccugcgacacccccgaggaggacggcaucaccuggacccuggaccagagcagcgaggugcugggcagcggcaagacccugaccauccaggugaaggaguucggcgacgccggccaguacaccugccacaagggcggcgaggugcugagccacagccugcugcugcugcacaagaaggaggacggcaucuggagcaccgacauccugaaggaccagaaggagcccaagaacaagaccuuccugagaugcgaggccaagaacuacagcggcagauucaccugcugguggcugaccaccaucagcaccgaccugaccuucagcgugaagagcagcagaggcagcagcgacccccagggcgugaccugcggcgccgccacccugagcgccgagagagugagaggcgacaacaaggaguacgaguacagcguggagugccaggaagauagcgccugccccgccgccgaggagagccugcccaucgaggugaugguggacgccgugcacaagcugaaguacgagaacuacaccagcagcuucuucaucagagauaucaucaagcccgacccccccaagaaccugcagcugaagccccugaagaacagccggcagguggaggugagcugggaguaccccgacaccuggagcaccccccacagcuacuucagccugaccuucugcgugcaggugcagggcaagagcaagagagagaagaaagauagaguguucaccgacaagaccagcgccaccgugaucugcagaaagaacgccagcaucagcgugagagcccaagauagauacuacagcagcagcuggagcgagugggccagcgugcccugcagcggcggcggcggcggcggcagcagaaaccugcccguggccacccccgaccccggcauguuccccugccugcaccacagccagaaccugcugagagccgugagcaacaugcugcagaaggcccggcagacccuggaguucuaccccugcaccagcgaggagaucgaccacgaagauaucaccaaagauaagaccagcaccguggaggccugccugccccuggagcugaccaagaacgagagcugccugaacagcagagagaccagcuucaucaccaacggcagcugccuggccagcagaaagaccagcuucaugauggcccugugccugagcagcaucuacgaggaccugaagauguaccagguggaguucaagaccaugaacgccaagcugcugauggaccccaagcggcagaucuuccuggaccagaacaugcuggccgugaucgacgagcugaugcaggcccugaacuucaacagcgagaccgugccccagaagagcagccuggaggagcccgacuucuacaagaccaagaucaagcugugcauccugcugcacgccuucagaaucagagccgugaccaucgacagagugaugagcuaccugaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 334 - RNA, 1829 nt, Artificial Sequence
  Synthetic: hIL12AB_003 (5UTR ORF  3UTR)
ucaagcuuuuggacccucguacagaagcuaauacgacucacuauagggaaauaagagagaaaagaagaguaagaagaaauauaagagccaccaugugucaccagcaguuggucaucucuugguuuucccugguuuuucuggcaucuccccucguggccaucugggaacugaagaaagacguuuacguuguagaauuggauugguauccggacgcuccuggagaaauggugguccucaccugugacaccccugaagaagacggaaucaccuggaccuuggaccagagcagugaggucuuaggcucuggcaaaacccugaccauccaagucaaagaguuuggagaugcuggccaguacaccugucacaaaggaggcgagguucuaagccauucgcuccugcugcuucacaaaaaggaagauggaauuugguccacugauauuuuaaaggaccagaaagaacccaaaaauaagaccuuucuaagaugcgaggccaagaauuauucuggacguuucaccugcugguggcugacgacaaucaguacugauuugacauucagugucaaaagcagcagaggcucuucugacccccaaggggugacgugcggagcugcuacacucucugcagagagagucagaggugacaacaaggaguaugaguacucaguggagugccaggaagauagugccugcccagcugcugaggagagucugcccauugaggucaugguggaugccguucacaagcucaaguaugaaaacuacaccagcagcuucuucaucagagauaucaucaaaccugacccacccaagaacuugcagcugaagccauuaaagaauucucggcagguggaggucagcugggaguacccugacaccuggaguacuccacauuccuacuucucccugacauucugcguucagguccagggcaagagcaagagagaaaagaaagauagagucuucacagauaagaccucagccacggucaucugccgcaaaaaugccagcauuagcgugcgggcccaggaccgcuacuauagcucaucuuggagcgaaugggcaucugugcccugcaguggcggagggggcggagggagcagaaaccuccccguggccacuccagacccaggaauguucccaugccuucaccacucccaaaaccugcugagggccgucagcaacaugcuccagaaggcccggcaaacuuuagaauuuuacccuugcacuucugaagagauugaucaugaagauaucacaaaagauaaaaccagcacaguggaggccuguuuaccauuggaauuaaccaagaaugagaguugccuaaauuccagagagaccucuuucauaacuaaugggaguugccuggccuccagaaagaccucuuuuaugauggcccugugccuuaguaguauuuaugaagauuugaagauguaccagguggaguucaagaccaugaaugcaaagcuucugauggauccuaagaggcagaucuuuuuagaucaaaacaugcuggcaguuauugaugagcugaugcaggcccugaauuucaacagugagacggugccacaaaaauccucccuugaagaaccagauuucuacaagaccaagaucaagcucugcauacuucuucaugcuuucagaauucgggcagugacuauugauagagugaugagcuaucugaaugcuuccugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 335 - RNA, 1832 nt, Artificial Sequence
  Synthetic: hIL12AB_004 (5UTR ORF  3UTR)
ucaagcuuuuggacccucguacagaagcuaauacgacucacuauagggaaauaagagagaaaagaagaguaagaagaaauauaagagccaccaugggcugccaccagcagcuggucaucagcugguucucccuggucuuccuggccagcccccugguggccaucugggagcugaagaaagacgucuacguaguagaguuggauugguacccagacgcaccuggagaaauggugguucucaccugugacacgccagaagaagacgguaucaccuggacgcuggaccagagcucagaaguucuuggcaguggaaaaacgcugaccauacaaguaaaagaauuuggggaugcuggccaguacaccugccacaaaggaggagaaguucucagccacagccugcugcugcugcacaagaaagaagauggcaucuggagcacagauauuuuaaaagaccagaaggagcccaagaacaaaaccuuccuucgaugugaggccaagaacuacaguggccgcuucaccugcugguggcucaccaccaucagcacagaccucaccuucucggugaagagcagccguggcagcucagacccccaaggagucaccuguggggcggccacgcugucggcagaaagaguucgaggugacaacaaggaauaugaauacucgguggaaugucaagaagauucggccugcccggcggcagaagaaagucuucccauagaagucaugguggaugcuguucacaaauuaaaauaugaaaacuacaccagcagcuucuucaucagagauaucaucaagccagacccgcccaagaaccugcagcugaagccccugaagaacagccggcagguggaaguuuccugggaguacccagauacguggagcacgccgcacagcuacuucagccucaccuucuguguacaaguacaaggcaagagcaagagagagaagaaagaucgugucuucacagauaaaaccucggcgacggucaucugcaggaagaaugccuccaucucgguucgagcccaggaccgcuacuacagcagcagcuggagugagugggccucggugcccugcagugguggcggcggcggcggcagcagaaaccuuccuguggccacgccggacccuggcauguucccgugccugcaccacagccaaaauuuacuucgagcuguuucuaacaugcugcagaaagcacggcaaacuuuagaauucuaccccugcaccucagaagaaauagaccaugaagauaucaccaaagauaaaaccagcacuguagaggccugccugccccuggagcucaccaagaaugaauccugccucaacagcagagagaccagcuucaucaccaauggcagcugccuggccagcaggaaaaccagcuucaugauggcgcucugccugagcagcaucuaugaagauuugaagauguaccaaguagaauuuaaaaccaugaaugccaagcugcucauggaccccaagcggcagauauuuuuggaucaaaacaugcuggcugucauugaugagcucaugcaagcauuaaacuucaacucagagacggugccccagaagagcagccuggaggagccagauuucuacaaaaccaagaucaagcucugcaucuuauuacaugccuuccgcauccgggcggucaccauugaccgugucauguccuacuuaaaugccagcugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 336 - RNA, 1829 nt, Artificial Sequence
  Synthetic: hIL12AB_005 (5UTR ORF  3UTR)
ucaagcuuuuggacccucguacagaagcuaauacgacucacuauagggaaauaagagagaaaagaagaguaagaagaaauauaagagccaccaugugccaccagcagcuggucaucagcugguucucccuggucuuccuggccagcccccugguggccaucugggagcugaagaaagacgucuacguaguagaguuggauugguacccagacgcaccuggagaaauggugguucucaccugugacacgccagaagaagacgguaucaccuggacgcuggaccagagcucagaaguucuuggcaguggaaaaacgcugaccauacaaguaaaagaauuuggggaugcuggccaguacaccugccacaaaggaggagaaguucucagccacagccugcugcugcugcacaagaaagaagauggcaucuggagcacagauauuuuaaaagaccagaaggagcccaagaacaaaaccuuccuucgaugugaggccaagaacuacaguggccgcuucaccugcugguggcucaccaccaucagcacagaccucaccuucucggugaagagcagccguggcagcucagacccccaaggagucaccuguggggcggccacgcugucggcagaaagaguucgaggugacaacaaggaauaugaauacucgguggaaugucaagaagauucggccugcccggcggcagaagaaagucuucccauagaagucaugguggaugcuguucacaaauuaaaauaugaaaacuacaccagcagcuucuucaucagagauaucaucaagccagacccgcccaagaaccugcagcugaagccccugaagaacagccggcagguggaaguuuccugggaguacccagauacguggagcacgccgcacagcuacuucagccucaccuucuguguacaaguacaaggcaagagcaagagagagaagaaagaucgugucuucacagauaaaaccucggcgacggucaucugcaggaagaaugccuccaucucgguucgagcccaggaccgcuacuacagcagcagcuggagugagugggccucggugcccugcagugguggcggcggcggcggcagcagaaaccuuccuguggccacgccggacccuggcauguucccgugccugcaccacagccaaaauuuacuucgagcuguuucuaacaugcugcagaaagcacggcaaacuuuagaauucuaccccugcaccucagaagaaauagaccaugaagauaucaccaaagauaaaaccagcacuguagaggccugccugccccuggagcucaccaagaaugaauccugccucaacagcagagagaccagcuucaucaccaauggcagcugccuggccagcaggaaaaccagcuucaugauggcgcucugccugagcagcaucuaugaagauuugaagauguaccaaguagaauuuaaaaccaugaaugccaagcugcucauggaccccaagcggcagauauuuuuggaucaaaacaugcuggcugucauugaugagcucaugcaagcauuaaacuucaacucagagacggugccccagaagagcagccuggaggagccagauuucuacaaaaccaagaucaagcucugcaucuuauuacaugccuuccgcauccgggcggucaccauugaccgugucauguccuacuuaaaugccagcugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 337 - RNA, 1829 nt, Artificial Sequence
  Synthetic: hIL12AB_006 (5UTR ORF  3UTR)
ucaagcuuuuggacccucguacagaagcuaauacgacucacuauagggaaauaagagagaaaagaagaguaagaagaaauauaagagccaccaugugccaccagcagcuggugaucagcugguucagccugguguuccuggccagcccccugguggccaucugggagcugaagaaggacguguacgugguggaguuggauugguaccccgacgcccccggcgagaugguggugcugaccugugacacccccgaggaggacggcaucaccuggacccuggaccagagcagcgaggugcugggcagcggcaagacccugaccauccaggugaaggaguucggggacgccggccaguacaccugccacaagggcggcgaggugcugagccacagccugcugcugcugcacaagaaggaggacggcaucuggagcacagauauccugaaggaccagaaggagcccaagaacaagaccuuccugagaugcgaggccaagaacuacagcggcagauucaccugcugguggcugaccaccaucagcacagauuugaccuucagcgugaagagcagcagaggcagcagcgacccccagggcgugaccugcggcgccgccacccugagcgccgagagagugagaggugacaacaaggaguacgaguacagcguggagugccaggaagauagcgccugccccgccgccgaggagagccugcccaucgaggugaugguggacgccgugcacaagcugaaguacgagaacuacaccagcagcuucuucaucagagauaucaucaagcccgacccgccgaagaaccugcagcugaagccccugaagaacagccggcagguggaggugagcugggaguaccccgacaccuggagcaccccccacagcuacuucagccugaccuucugcgugcaggugcagggcaagagcaagagagagaagaaagauagaguguucacagauaagaccagcgccaccgugaucugcagaaagaacgccagcaucagcgugagagcccaagauagauacuacagcagcagcuggagcgagugggccagcgugcccugcagcggcggcggcggcggcggcagcagaaaccugcccguggccacccccgaccccggcauguuccccugccugcaccacagccagaaccugcugagagccgugagcaacaugcugcagaaggcccggcagacccuggaguucuaccccugcaccagcgaggagaucgaccacgaagauaucaccaaagauaagaccagcaccguggaggccugccugccccuggagcugaccaagaaugaaagcugccugaacagcagagagaccagcuucaucaccaacggcagcugccuggccagcagaaagaccagcuucaugauggcccugugccugagcagcaucuacgaggaccugaagauguaccagguggaguucaagaccaugaacgccaagcugcugauggaccccaagcggcagaucuuccuggaccagaacaugcuggccgugaucgacgagcugaugcaggcccugaacuucaacagcgagaccgugccccagaagagcagccuggaggagcccgacuucuacaagaccaagaucaagcugugcauccugcugcacgccuucagaaucagagccgugaccaucgacagagugaugagcuaccugaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 338 - RNA, 1829 nt, Artificial Sequence
  Synthetic: hIL12AB_007 (5UTR ORF  3UTR)
ucaagcuuuuggacccucguacagaagcuaauacgacucacuauagggaaauaagagagaaaagaagaguaagaagaaauauaagagccaccaugugccaccagcagcuugucaucuccugguucucucuugucuuccuugcuucuccucuuguggccaucugggagcugaagaaggacguuuacguaguggaguuggauugguacccugacgcaccuggagaaauggugguucucaccugugacacuccugaggaggacgguaucaccuggacguuggaccagucuucugagguucuuggcaguggaaaaacucuuacuauucaggugaaggaguuuggagaugcuggccaguacaccugccacaaggguggugaaguucucagccacaguuuacuucuucuucacaagaaggaggauggcaucuggucuacugacauuuuaaaagaccagaaggagcccaagaacaaaacauuccuucguugugaagccaagaacuacaguggucguuucaccugcugguggcuuacuacuauuucuacugaccuuacuuucucugugaagucuucucguggcucuucugacccucagggugucaccuguggggcugcuacucuuucugcugagcgugugcguggugacaacaaggaguaugaauacucgguggagugccaggaagauucugccugcccugcugcugaggagucucuuccuauugaggugaugguggaugcugugcacaaguuaaaauaugaaaacuacacuucuucuuucuucauucgugacauuauaaaaccugacccucccaagaaccuucaguuaaaaccuuuaaaaaacucucgucagguggagguguccugggaguacccugacacguggucuacuccucacuccuacuucucucuuacuuucuguguccaggugcagggcaaguccaagcgugagaagaaggaccgugucuucacugacaaaacaucugcuacugucaucugcaggaagaaugcauccaucucugugcgugcucaggaccguuacuacagcucuuccuggucugagugggcuucugugcccugcucuggcggcggcggcggcggcagcagaaaucuuccuguggcuacuccugacccuggcauguuccccugccuucaccacucgcagaaccuucuucgugcugugagcaacaugcuucagaaggcucgucaaacuuuagaauucuaccccugcacuucugaggagauugaccaugaagauaucaccaaagauaaaacaucuacuguggaggccugccuuccuuuagagcugaccaagaaugaauccugcuuaaauucucgugagacgucuuucaucaccaauggcagcugccuugccucgcgcaaaacaucuuucaugauggcucuuugccuuucuuccaucuaugaagauuuaaaaauguaccagguggaguucaagaccaugaaugcaaagcuucucauggaccccaagcgucagauauuuuuggaccagaacaugcuugcugucauugaugagcucaugcaggcuuuaaacuucaacucugagacggugccucagaagucuucuuuagaagagccugacuucuacaagaccaagauaaaacuuugcauucuucuucaugcuuuccgcauccgugcugugacuauugaccgugugauguccuacuuaaaugcuucuugauaauaggcuggagccucgguggccaagcuucuugccccuugggccuccccccagccccuccuccccuuccugcacccguaccccccaaacaccauugucacacuccaguggucuuugaauaaagucugagugggcggc

SEQ ID NO: 339 - RNA, 1829 nt, Artificial Sequence
  Synthetic: hIL12AB_008 (5UTR ORF  3UTR)
ucaagcuuuuggacccucguacagaagcuaauacgacucacuauagggaaauaagagagaaaagaagaguaagaagaaauauaagagccaccaugugucaucaacaacucgugauuagcugguucagucucguguuccuggccucuccgcugguggccaucugggagcuuaagaaggacguguacgugguggagcucgauugguaccccgacgcaccuggcgagaugguggugcuaaccugcgauacccccgaggaggacgggaucacuuggacccuggaucagaguagcgaaguccugggcucuggcaaaacacucacaauccaggugaaggaauucggagacgcuggucaguacacuugccacaaggggggugaagugcugucucacagccugcuguuacugcacaagaaggaggaugggaucuggucaaccgacauccugaaggaucagaaggagccuaagaacaagaccuuucugaggugugaagcuaagaacuauuccggaagauucacuugcuggugguugaccacaaucagcacugaccugaccuuuuccgugaaguccagcagaggaagcagcgauccucagggcguaacgugcggcgcggcuacccugucagcugagcggguuagaggcgacaacaaagaguaugaguacuccguggagugucaggaagauagcgccugccccgcagccgaggagagucugcccaucgaggugaugguggacgcuguccauaaguuaaaauacgaaaauuacacaaguuccuuuuucauccgcgauauuaucaaacccgauccccccaagaaccugcagcugaagccccugaagaauagccgacagguggaagucucuugggaguauccugacaccugguccacgccucacagcuacuuuagucugacuuucuguguccagguccagggcaagagcaagagagagaaaaaggauagaguguuuacugacaaaacaucugcuacagucaucugcagaaagaacgccaguaucucagugagggcgcaagauagauacuacaguaguagcuggagcgaaugggcuagcgugcccuguucagggggcggcggagggggcuccaggaaucugcccguggccacccccgacccugggauguucccuugccuccaucacucacagaaccugcucagagcagugagcaacaugcuccaaaaggcccgccagacccuggaguuuuacccuuguacuucagaagagaucgaucacgaagauauaacaaaggauaaaaccagcaccguggaggccugucugccucuggaacucacaaagaaugaaagcugucugaauuccagggaaaccuccuucauuacuaacggaagcugucucgcaucucgcaaaacaucauucaugauggcccucugccugucuucuaucuaugaagaucucaagauguaucagguggaguucaaaacaaugaacgccaagcugcugauggaccccaagcggcagaucuuccuggaccagaacaugcuggcagugaucgaugagcugaugcaagccuugaacuucaacucagagacggugccgcaaaaguccucguuggaggaaccagauuuuuacaaaaccaaaaucaagcuguguauccuucuucacgccuuucggaucagagccgugacuaucgaccgggugaugucauaccugaaugcuuccugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 340 - RNA, 1829 nt, Artificial Sequence
  Synthetic: hIL12AB_009 (5UTR ORF  3UTR)
ucaagcuuuuggacccucguacagaagcuaauacgacucacuauagggaaauaagagagaaaagaagaguaagaagaaauauaagagccaccaugugccaccagcagcuggucaucagcugguuuagccuggucuuccuggccagcccccugguggccaucugggagcugaagaaagacgucuacguaguagaguuggauugguacccagacgcaccuggagaaauggugguucucaccugcgacacgccagaagaagacgguaucaccuggacgcuggaccagagcagcgaaguacugggcaguggaaaaacgcugaccauacaaguaaaagaauuuggcgaugcuggccaguacaccugccacaaaggaggagaaguacugagccacagccugcugcugcugcacaagaaagaagauggcaucuggagcaccgacauuuuaaaagaccagaaggagcccaagaacaaaaccuuccuucgaugugaggcgaagaacuacaguggccgcuucaccugcugguggcucaccaccaucagcaccgaccucaccuucucggugaagagcagccgugguagcucagacccccaaggagucaccuguggggcggccacgcugucggcagaaagaguucgaggcgacaacaaggaauaugaauacucgguggaaugucaagaagauucggccugcccggcggcagaagaaagucugcccauagaagucaugguggaugcuguucacaaauuaaaauaugaaaacuacaccagcagcuucuucaucagagauaucaucaagccagacccccccaagaaccugcagcugaagccccugaagaacagccggcagguggaaguuuccugggaguacccagauacguggagcacgccgcacagcuacuucagccucaccuucuguguacaaguacaaggcaagagcaagagagagaagaaagaucgugucuucaccgacaaaaccucggcgacggucaucugcaggaagaaugcaagcaucucgguucgagcccaggaccgcuacuacagcagcagcuggagugagugggccucggugcccugcagugguggcggcggcggcggcagcagaaaccuuccuguggccacgccggacccuggcauguuuccgugccugcaccacagccaaaauuuauuacgagcuguuagcaacaugcugcagaaagcacggcaaacuuuagaauucuaccccugcaccucagaagaaauagaccaugaagauaucaccaaagauaaaaccagcacuguagaggccugccugccccuggagcucaccaagaacgagagcugccucaauagcagagagaccagcuucaucaccaauggcagcugccuggccagcaggaaaaccagcuucaugauggcgcucugccugagcagcaucuaugaagaucugaagauguaccaaguagaauuuaaaaccaugaaugccaagcugcucauggaccccaagcggcagauauuccucgaccaaaacaugcuggcugucauugaugagcucaugcaagcauuaaacuucaacucagagacggugccccagaagagcagccuggaggagccagauuucuacaaaaccaagaucaagcucugcaucuuauuacaugccuuccgcauccgggcggucaccauugaccgugucauguccuacuuaaaugccagcugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 341 - RNA, 1829 nt, Artificial Sequence
  Synthetic: hIL12AB_010 (5UTR ORF  3UTR)
ucaagcuuuuggacccucguacagaagcuaauacgacucacuauagggaaauaagagagaaaagaagaguaagaagaaauauaagagccaccaugugccaccagcagcuugucaucuccugguuuucucuugucuuccucgcuucuccucuuguggccaucugggagcugaagaaagacgucuacguaguagaguuggauugguacccggacgcuccuggagaaauggugguucucaccugcgacacuccugaagaagacgguaucaccuggacgcuggaccaaagcagcgaaguuuuaggcucuggaaaaacgcugaccauacaaguaaaagaauuuggcgacgcuggccaguacacgugccacaaaggaggagaaguuuuaagccacaguuuacuucuucuucacaagaaagaagauggcaucuggaguacagauauuuuaaaagaccagaaggagccuaagaacaaaaccuuccuccgcugugaagcuaagaacuacaguggucguuucaccugcugguggcucaccaccaucuccacugaccucaccuucucuguaaaaucaagccgugguucuucugacccccaaggagucaccuguggggcugccacgcucagcgcugaaagaguucgaggcgacaacaaggaauaugaauauucuguggaaugucaagaagauucugccugcccggcggcagaagaaagucuucccauagaagucaugguggacgcuguucacaaauuaaaauaugaaaacuacaccagcagcuucuucauucgugacaucaucaaaccagacccuccuaagaaccuucaguuaaaaccgcugaagaacagccggcagguggaaguuuccugggaguacccagauacguggaguacgccgcacuccuacuucaguuuaaccuucuguguacaaguacaaggaaaaucaaaaagagagaagaaagaucgugucuucacugacaaaacaucugccacggucaucugccguaagaacgcuuccaucucgguucgagcccaggaccgcuacuacagcagcagcuggagugagugggcaucuguucccugcagugguggcggcggcggcggcagccgcaaccuuccuguggccacgccggacccuggcauguucccgugccuucaccacucgcaaaaucuucuucgugcuguuucuaacaugcugcagaaggcgcggcaaacuuuagaauucuacccgugcacuucugaagaaauagaccaugaagauaucaccaaagauaaaaccagcacgguggaggccugccuuccuuuagaacuuacuaagaacgaaaguugccuuaacagccgugagaccagcuucaucaccaauggcagcugccuugcuagcaggaagaccagcuucaugauggcgcugugccuuucuuccaucuaugaagaucuuaagauguaccaaguagaauuuaaaaccaugaaugccaaauuauuaauggaccccaagcggcagauauuccucgaccaaaacaugcuggcugucauugaugagcucaugcaagcauuaaacuucaacucagaaacuguuccccagaagucaucuuuagaagaaccagauuucuacaaaacaaaaauaaaacucugcauucuucuucaugccuuccgcauccgugcugucaccauugaccgugucauguccuacuuaaaugcuucuugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 342 - RNA, 1829 nt, Artificial Sequence
  Synthetic: hIL12AB_011 (5UTR ORF  3UTR)
ucaagcuuuuggacccucguacagaagcuaauacgacucacuauagggaaauaagagagaaaagaagaguaagaagaaauauaagagccaccaugugccaccagcagcuggugaucagcugguucagccugguguuccuggccagcccccugguggccaucugggagcugaagaaggacguguacgugguggaguuggauugguacccggacgcgccgggggagaugguggugcugacgugcgacacgccggaggaggacgggaucacguggacgcuggaccagagcagcgaggugcuggggagcgggaagacgcugacgauccaggugaaggaguucggggacgcggggcaguacacgugccacaaggggggggaggugcugagccacagccugcugcugcugcacaagaaggaggacgggaucuggagcacagauauccugaaggaccagaaggagccgaagaacaagacguuccugaggugcgaggcgaagaacuacagcgggagguucacgugcugguggcugacgacgaucagcacggaccugacguucagcgugaagagcagcagggggagcagcgacccgcagggggugacgugcggggcggcgacgcugagcgcggagagggugaggggugacaacaaggaguacgaguacagcguggagugccaggaagauagcgcgugcccggcggcggaggagagccugccgaucgaggugaugguggacgcggugcacaagcugaaguacgagaacuacacgagcagcuucuucaucagagauaucaucaagccggacccgccgaagaaccugcagcugaagccgcugaagaacagcaggcagguggaggugagcugggaguacccagauacguggagcacgccgcacagcuacuucagccugacguucugcgugcaggugcaggggaagagcaagagggagaagaaagauaggguguucacagauaagacgagcgcgacggugaucugcaggaagaacgcgagcaucagcgugagggcgcaagauagguacuacagcagcagcuggagcgagugggcgagcgugccgugcagcggggggggggggggggggagcaggaaccugccgguggcgacgccggacccggggauguucccgugccugcaccacagccagaaccugcugagggcggugagcaacaugcugcagaaggcgaggcagacgcuggaguucuacccgugcacgagcgaggagaucgaccacgaagauaucacgaaagauaagacgagcacgguggaggcgugccugccgcuggagcugacgaagaacgagagcugccugaacagcagggagacgagcuucaucacgaacgggagcugccuggcgagcaggaagacgagcuucaugauggcgcugugccugagcagcaucuacgaggaccugaagauguaccagguggaguucaagacgaugaacgcgaagcugcugauggacccgaagaggcagaucuuccuggaccagaacaugcuggcggugaucgacgagcugaugcaggcgcugaacuucaacagcgagacggugccgcagaagagcagccuggaggagccagauuucuacaagacgaagaucaagcugugcauccugcugcacgcguucaggaucagggcggugacgaucgacagggugaugagcuaccugaacgcgagcugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 343 - RNA, 1829 nt, Artificial Sequence
  Synthetic: hIL12AB_012 (5UTR ORF  3UTR)
ucaagcuuuuggacccucguacagaagcuaauacgacucacuauagggaaauaagagagaaaagaagaguaagaagaaauauaagagccaccaugugccaucagcagcuggugaucagcugguucagccucguguuucuggccagcccccugguggccauuugggaacucaagaaggacguguacguuguggaacucgacugguacccugacgccccaggcgaaaugguggucuuaaccugcgacaccccugaggaggacggaaucaccuggaccuuggaccagagcuccgagguccucggcaguggcaagacccugaccauacaggugaaagaauuuggagacgcagggcaauacacaugucacaagggcggggagguucuuucucacucccuucugcuucuacauaaaaaggaagacggaauuuggucuaccgacauccucaaggaccaaaaggagccuaagaauaaaaccuucuuacgcugugaagcuaaaaacuacagcggcagauucacuugcugguggcucaccaccauuucuaccgaccugaccuucucggugaagucuucaaggggcucuagugauccacagggagugacaugcggggccgccacacugagcgcugaacgggugaggggcgauaacaaggaguaugaauacucugucgagugucaggaggauucagcuugucccgcagcugaagagucacuccccauagagguuauggucgaugcugugcauaaacugaaguacgaaaacuacaccagcagcuucuucauuagagauauuauaaaaccugacccccccaagaaccugcaacuuaaaccccugaaaaacucucggcaggucgaaguuagcugggaguacccugauacuugguccaccccccacucguacuucucacugacuuucugugugcaggugcagggcaagagcaagagagagaaaaaagaucguguauucacagauaagaccucugccaccgugaucugcagaaaaaacgcuuccaucagugucagagcccaagaccgguacuauaguaguagcuggagcgagugggcaaguguccccugcucuggcggcggagggggcggcucucgaaaccuccccgucgcuaccccugauccaggaauguucccuugccugcaucacucacagaaucugcugagagcggucagcaacaugcugcagaaagcuaggcaaacacuggaguuuuauccuuguaccucagaggagaucgaccacgaggauauuaccaaagauaagaccagcacgguggaggccugcuugccccuggaacugacaaagaaugaauccugccuuaauagccgugagaccucuuuuauaacaaacggauccugccuggccagcaggaagaccuccuucaugauggcccucugccuguccucaaucuacgaagaccugaagauguaccagguggaauuuaaaacuaugaacgccaagcuguugauggaccccaagcggcagaucuuucuggaucaaaauaugcuggcugugaucgacgaacugaugcaggcccucaacuuuaacagcgagaccgugccacaaaagagcagucuugaggagcccgacuucuacaagaccaagaucaagcugugcauccuccuucaugccuucaggauaagagcugucaccaucgacagagucaugaguuaccugaaugcauccugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 344 - RNA, 1829 nt, Artificial Sequence
  Synthetic: hIL12AB_013 (5UTR ORF  3UTR)
ucaagcuuuuggacccucguacagaagcuaauacgacucacuauagggaaauaagagagaaaagaagaguaagaagaaauauaagagccaccaugugccaccagcagcuggucaucuccugguucagucuugucuuccuggccucgccgcugguggccaucugggagcugaagaaagacguuuacguaguagaguuggauugguacccagacgcaccuggagaaauggugguccucaccugugacacgccagaagaagacgguaucaccuggacgcuggaccagagcagugaaguucuuggaaguggaaaaacgcugaccauacaaguaaaagaauuuggagaugcuggccaguacaccugccacaaaggaggagaaguucucagccacaguuuauuauuacuucacaagaaagaagauggcaucugguccacagauauuuuaaaagaccagaaggagcccaaaaauaaaacauuucuucgaugugaggccaagaacuacaguggucguuucaccugcugguggcugaccaccaucuccacagaccucaccuucaguguaaaaagcagccgugguucuucugacccccaaggagucaccuguggggcugccacgcucucugcagaaagaguucgaggugacaacaaagaauaugaguacucgguggaaugucaagaagauucggccugcccagcugcugaggagagucuucccauagaagucaugguggaugcuguucacaaauuaaaauaugaaaacuacaccagcagcuucuucaucagagauaucaucaaaccugacccgcccaagaacuuacagcugaagccgcugaaaaacagccggcagguagaaguuuccugggaguacccagauaccugguccacgccgcacuccuacuucucccucaccuucuguguacaaguacaaggcaagagcaagagagagaagaaagaucgugucuucacagauaaaacaucagccacggucaucugcaggaaaaaugccagcaucucggugcgggcccaggaccgcuacuacagcagcagcuggagugagugggcaucugugcccugcagugguggugggggugguggcagcagaaaccuuccuguggccacuccagacccuggcauguucccgugccuucaccacucccaaaauuuacuucgagcuguuucuaacaugcugcagaaagcacggcaaacuuuagaauucuacccgugcacuucugaagaaauugaccaugaagauaucacaaaagauaaaaccagcacaguggaggccugucuuccuuuagagcugaccaaaaaugaauccugccucaacagcagagagaccagcuucaucaccaauggcagcugccuggccuccaggaaaaccagcuucaugauggcgcucugccucagcuccaucuaugaagauuugaagauguaccaaguagaauuuaaaaccaugaaugccaaauuauuaauggaccccaagaggcagauauuuuuagaucaaaacaugcuggcaguuauugaugagcucaugcaagcauuaaacuucaacagugagacgguaccucaaaaaagcagccuugaagagccagauuucuacaaaaccaagaucaaacucugcauuuuacuucaugccuuccgcauccgggcggucaccauugaccgugucauguccuacuuaaaugccucgugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 345 - RNA, 1829 nt, Artificial Sequence
  Synthetic: hIL12AB_014 (5UTR ORF  3UTR)
ucaagcuuuuggacccucguacagaagcuaauacgacucacuauagggaaauaagagagaaaagaagaguaagaagaaauauaagagccaccaugugccaccagcagcuugugauuucuugguucucucuuguguuccuugcuucuccucuuguggcuauuugggaguuaaaaaaggacguguacgugguggagcuugacugguacccugacgcaccuggcgagaugguggugcuuacuugugacacuccugaggaggacggcauuacuuggacgcuugaccagucuucugaggugcuuggcucuggcaaaacacuuacuauucaggugaaggaguucggggaugcuggccaguacacuugccacaagggcggcgaggugcuuucucacucucuucuucuucuucacaagaaggaggacggcauuuggucuacugacauuuuaaaagaccagaaggagcccaagaacaaaacauuccuucguugcgaggccaagaacuacucuggccguuucacuugcugguggcuuacuacuauuucuacugaccuuacuuucucugugaagucuucucguggcucuucugacccucagggcgugacuuguggggcugcuacucuuucugcugagcgugugcguggugacaacaaggaguacgaguacucuguggagugccaggaagauucugcuugcccugcugcugaggagucucuuccuauugaggugaugguggaugcugugcacaaguuaaaauacgagaacuacacuucuucuuucuucauucgugacauuauuaagccugacccucccaagaaccuucaguuaaaaccuuuaaaaaacucucgucagguggaggugucuugggaguacccugacacuuggucuacuccucacucuuacuucucucuuacuuucugcgugcaggugcagggcaagucuaagcgugagaagaaggaccguguguucacugacaaaacaucugcuacugugauuugcaggaagaaugcaucuauuucugugcgugcucaggaccguuacuacucuucuucuuggucugagugggcuucugugccuugcucuggcggcggcggcggcggcuccagaaaucuuccuguggcuacuccugacccuggcauguucccuugccuucaccacucucagaaccuucuucgugcugugagcaacaugcuucagaaggcucgucaaacucuugaguucuacccuugcacuucugaggagauugaccacgaagauaucaccaaagauaaaacaucuacuguggaggcuugccuuccucuugagcuuaccaagaaugaaucuugcuuaaauucucgugagacgucuuucaucaccaacggcucuugccuugccucgcgcaaaacaucuuucaugauggcucuuugccuuucuucuauuuacgaagauuuaaaaauguaccagguggaguucaaaacaaugaaugcaaagcuucuuauggaccccaagcgucagauuuuccuugaccagaacaugcuugcugugauugacgagcuuaugcaggcuuuaaauuucaacucugagacggugccucagaagucuucucuugaggagccugacuucuacaagaccaagauuaagcuuugcauucuucuucaugcuuuccguauucgugcugugacuauugaccgugugaugucuuacuuaaaugcuucuugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 346 - RNA, 1829 nt, Artificial Sequence
  Synthetic: hIL12AB_015 (5UTR ORF  3UTR)
ucaagcuuuuggacccucguacagaagcuaauacgacucacuauagggaaauaagagagaaaagaagaguaagaagaaauauaagagccaccaugugucaccagcagcuggugaucagcugguuuagccugguguuucuggccagcccccugguggccaucugggaacugaagaaagacguguacgugguagaacuggauugguauccggacgcucccggcgaaaugguggugcugaccugugacacccccgaagaagacggaaucaccuggacccuggaccagagcagcgaggugcugggcagcggcaaaacccugaccauccaagugaaagaguuuggcgaugccggccaguacaccugucacaaaggcggcgaggugcuaagccauucgcugcugcugcugcacaaaaaggaagauggcaucuggagcaccgauauccugaaggaccagaaagaacccaaaaauaagaccuuucuaagaugcgaggccaagaauuauagcggccguuucaccugcugguggcugacgaccaucagcaccgaucugaccuucagcgugaaaagcagcagaggcagcagcgacccccaaggcgugacgugcggcgccgccacccugagcgccgagagagugagaggcgacaacaaggaguaugaguacagcguggagugccaggaagauagcgccugccccgccgccgaggagagccugcccaucgaggugaugguggaugccgugcacaagcugaaguaugaaaacuacaccagcagcuucuucaucagagauaucaucaaacccgacccccccaagaaccugcagcugaagccccugaagaauagccggcagguggaggugagcugggaguaccccgacaccuggagcaccccccauagcuacuucagccugaccuucugcgugcaggugcagggcaagagcaagagagaaaagaaagauagaguguucacagauaagaccagcgccacggugaucugcagaaaaaaugccagcaucagcgugagagcccaagauagauacuauagcagcagcuggagcgaaugggccagcgugcccugcagcggcggcggcggcggcggcagcagaaaccugcccguggccacccccgaccccggcauguuccccugccugcaccacagccaaaaccugcugagagccgugagcaacaugcugcagaaggcccggcagacccuggaauuuuaccccugcaccagcgaagagaucgaucaugaagauaucaccaaagauaaaaccagcaccguggaggccugucugccccuggaacugaccaagaaugagagcugccuaaauagcagagagaccagcuucauaaccaauggcagcugccuggccagcagaaagaccagcuuuaugauggcccugugccugagcagcaucuaugaagaccugaagauguaccagguggaguucaagaccaugaaugccaagcugcugauggaucccaagcggcagaucuuucuggaucaaaacaugcuggccgugaucgaugagcugaugcaggcccugaauuucaacagcgagaccgugccccaaaaaagcagccuggaagaaccggauuuuuauaaaaccaaaaucaagcugugcauacugcugcaugccuucagaaucagagccgugaccaucgauagagugaugagcuaucugaaugccagcugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 347 - RNA, 1829 nt, Artificial Sequence
  Synthetic: hIL12AB_016 (5UTR ORF  3UTR)
ucaagcuuuuggacccucguacagaagcuaauacgacucacuauagggaaauaagagagaaaagaagaguaagaagaaauauaagagccaccaugugccaccagcagcuggucaucagcugguucagccuggucuuccuggccagcccccugguggccaucugggagcugaagaaggacguauacguaguggaguuggauugguacccagacgcuccuggggagaugguggugcugaccugugacaccccagaagaggacgguaucaccuggacccuggaccagagcucagaagugcugggcaguggaaaaacccugaccauccaggugaaggaguuuggagaugcuggccaguacaccugccacaaggguggugaagugcugagccacagccugcugcugcugcacaagaaggaggauggcaucuggagcacagauauccugaaggaccagaaggagcccaagaacaagaccuuccuucgcugugaagccaagaacuacaguggccgcuucaccugcugguggcugaccaccaucagcacagaccucaccuucucggugaagagcagcagaggcagcucagacccccagggugucaccuguggggcggccacgcugucggcggagagaguucgaggugacaacaaggaguaugaauacucgguggagugccaggaagauucggcgugcccggcggcagaagagagccugcccauagaagugaugguggaugcugugcacaagcugaaguaugaaaacuacaccagcagcuucuucaucagagauaucaucaagccagacccgcccaagaaccugcagcugaagccccugaagaacagccggcagguggagguuuccugggaguacccagauacguggagcaccccccacagcuacuucagccugaccuucuguguccaggugcagggcaagagcaagagagagaagaaagauagagucuucacagauaagaccucggccacggucaucugcagaaagaaugccuccaucucgguucgagcccaagauagauacuacagcagcagcuggucagaaugggccucggugcccugcagugguggcggcggcggcggcagcagaaaccugccuguugccaccccagacccugggauguuccccugccugcaccacagccagaacuuauuacgagcuguuucuaacaugcugcagaaggcccggcagacccuggaguucuaccccugcaccucagaagagauugaccaugaagauaucaccaaagauaagaccagcacuguagaggccugccugccccuggagcugaccaagaaugaaagcugccugaacagcagagagaccagcuucaucaccaauggaagcugccuggccagcagaaagaccagcuucaugauggcccugugccugagcagcaucuaugaagaccugaagauguaccagguggaguucaagaccaugaaugcaaagcugcugauggaccccaagcggcagauauuuuuggaccagaacaugcuggcugucauugaugagcugaugcaggcccugaacuucaacucagaaacuguaccccagaagagcagccuggaggagccagauuucuacaagaccaagaucaagcugugcauccugcuucaugcuuucagaaucagagcugucaccauugaccgcgugaugagcuacuuaaaugccucgugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 348 - RNA, 1829 nt, Artificial Sequence
  Synthetic: hIL12AB_017 (5UTR ORF  3UTR)
ucaagcuuuuggacccucguacagaagcuaauacgacucacuauagggaaauaagagagaaaagaagaguaagaagaaauauaagagccaccaugugccaccagcagcugguaaucagcugguuuucccucgucuuucuggcaucaccccugguggcuaucugggagcugaagaaggacguguacgugguggagcuggauugguacccugacgccccgggggaaauggugguguuaaccugcgacacgccugaggaggacggcaucaccuggacgcuggaccagagcagcgaggugcuugggucugguaaaacucugacuauucaggugaaagaguucggggaugccggccaauauacuugccacaaggguggcgaggugcuuucucauucucugcuccugcugcacaagaaagaagauggcauuuggucuacugauauucugaaagaccagaaggagcccaagaacaagaccuuucugagaugcgaggcuaaaaacuacagcggaagauuuaccugcugguggcugaccacaaucucaaccgaccugacauuuucagugaaguccagcagagggagcuccgacccucagggcgugaccugcggagccgccacucuguccgcagaaagagugagaggugauaauaaggaguacgaguauucagucgagugccaagaagauucugccugcccagccgccgaggagagccugccaaucgaggugaugguagaugcgguacacaagcugaaguaugagaacuacacauccuccuucuucauaagagauauuaucaagccugacccaccuaaaaaucugcaacucaagccuuugaaaaauucacggcagguggaggugagcugggaguacccugauacuuggagcaccccccauagcuacuuuucgcugacauucugcguccaggugcagggcaagucaaagagagagaagaaggaucgcguguucacugauaaaacaagcgccacagugaucugcagaaaaaacgcuagcauuagcgucagagcacaggaccgguauuacuccagcuccuggagcgaaugggcaucugugcccugcagcggugggggcggaggcggauccagaaaccuccccguugccacaccugauccuggaauguuccccugucugcaccacagccagaaccugcugagagcagugucuaacaugcuccagaaggccaggcagacccuggaguuuuaccccugcaccagcgaggaaaucgaucacgaagauaucaccaaagauaaaaccuccaccguggaggccugccugccccuggaacugaccaaaaacgagagcugccugaauagcagggagaccuccuucaucaccaacggcucaugccuugccagccggaaaacuagcuucaugauggcccugugccugucuucgaucuaugaggaccugaaaauguaccaggucgaauuuaagacgaugaacgcaaagcugcugauggaccccaagcggcagaucuuucuggaccagaacaugcuggcagucauagaugaguugaugcaggcauuaaacuucaacagcgagaccgugccucagaaguccagccucgaggagccagauuuuuauaagaccaagaucaaacuaugcauccugcugcaugcuuucaggauuagagccgucaccaucgaucgagucaugucuuaccugaaugcuagcugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 349 - RNA, 1829 nt, Artificial Sequence
  Synthetic: hIL12AB_018 (5UTR ORF  3UTR)
ucaagcuuuuggacccucguacagaagcuaauacgacucacuauagggaaauaagagagaaaagaagaguaagaagaaauauaagagccaccaugugucaccaacaguuaguaaucuccugguuuucucugguguuucuggccagcccccucguggccaucugggagcuuaaaaaggacguuuacgugguggaguuggauugguaucccgacgcuccaggcgaaauggucgugcugaccugcgauaccccugaagaagacgguaucaccuggacgcuggaccagucuuccgaggugcuuggaucuggcaaaacacugacaauacaaguuaaggaguucggggacgcagggcaguacaccugccacaaaggcggcgagguccugagucacucccuguuacugcuccacaagaaagaggacggcauuugguccaccgacauucugaaggaccagaaggagccuaagaauaaaacuuuccugagaugcgaggcaaaaaacuauagcggccgcuuuacuugcugguggcuuacaacaaucucuaccgauuuaacuuucuccgugaagucuagcagaggauccucugacccgcaaggagugacuugcggagccgccaccuugagcgccgaaagaguccguggcgauaacaaagaauacgaguacuccguggagugccaggaagauuccgccugcccagcugccgaggagucccugcccauugaagugaugguggaugccguccacaagcugaaguacgaaaacuauaccagcagcuucuucauccgggauaucauuaagcccgacccuccuaaaaaccugcaacuuaagccccuaaagaauagucggcagguugaggucagcugggaauauccugacacauggagcaccccccacucuuauuucucccugaccuucugcgugcaggugcagggcaagaguaaacgggagaaaaaagauagggucuuuaccgauaaaaccagcgcuacgguuaucugucggaagaacgcuuccaucuccguccgcgcucaggaucguuacuacucguccucauggagcgagugggccagcgugcccugcagcggcggcgguggaggcggauccagaaaucugccuguugccacaccagacccuggcauguuccccugucugcaucauagccagaaccugcucagagccgugagcaacaugcuccagaaggccaggcaaacuuuggaguucuacccguguacaucugaggaaaucgaucacgaagauauaaccaaagauaaaaccucuacaguagaggcuuguuugccccuggaguugaccaaaaacgagaguugccugaacagucgcgagacgagcuucauuacuaacggcagcugucucgccuccagaaaaacauccuucaugauggcccugugucuuuccagcauauacgaagaccugaaaauguaccaggucgaguucaaaacaaugaacgccaagcugcuuauggaccccaagcggcagaucuuccucgaccaaaacaugcucgcugugaucgaugagcugaugcaggcucucaacuucaauuccgaaacagugccacagaaguccagucuggaagaacccgacuucuacaagaccaagauuaagcuguguauuuugcugcaugcguuuagaaucagagccgugaccauugaucgggugaugagcuaccugaacgccucgugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 350 - RNA, 1829 nt, Artificial Sequence
  Synthetic: hIL12AB_019 (5UTR ORF  3UTR)
ucaagcuuuuggacccucguacagaagcuaauacgacucacuauagggaaauaagagagaaaagaagaguaagaagaaauauaagagccaccaugugccaccagcagcuugucaucuccugguuuucucuugucuuccuggccucgccgcugguggccaucugggagcugaagaaagacguuuacguaguagaguuggauugguacccagacgcaccuggagaaauggugguucucaccugugacacuccugaagaagacgguaucaccuggacgcuggaccaaagcucagaaguucuuggcaguggaaaaacgcugaccauacaaguaaaagaauuuggggaugcuggccaguacacgugccacaaaggaggagaaguucucagccacaguuuacuucuucuucacaagaaagaagauggcaucugguccacagauauuuuaaaagaccagaaggagcccaagaacaaaaccuuccuccgcugugaggccaagaacuacaguggucguuucaccugcugguggcucaccaccaucuccacugaccucaccuucucuguaaaaagcagccgugguucuucugacccccaaggagucaccuguggggcugccacgcucucggcagaaagaguucgaggugacaacaaggaauaugaauauucuguggaaugucaagaagauucugccugcccggcggcagaagaaagucuucccauagaagucaugguggaugcuguucacaaauuaaaauaugaaaacuacaccagcagcuucuucauucgugacaucaucaaaccagacccgcccaagaaccuucaguuaaaaccuuuaaaaaacagccggcagguagaaguuuccugggaguacccagauacgugguccacgccgcacuccuacuucaguuuaaccuucuguguacaaguacaaggaaaaucaaaaagagagaagaaagaucgugucuucacugacaaaacaucugccacggucaucugcaggaagaaugccuccaucucgguucgagcccaggaccgcuacuacagcagcagcuggagugagugggcaucuguucccugcagugguggcggcggcggcggcagccgcaaccuuccuguggccacgccggacccuggcauguucccgugccuucaccacucccaaaaucuucuucgugcuguuucuaacaugcugcagaaggcgcgccaaacuuuagaauucuacccgugcacuucugaagaaauagaccaugaagauaucaccaaagauaaaaccagcacgguggaggccugccuuccuuuagagcugaccaagaaugaauccugccucaacagcagagagaccagcuucaucaccaauggcagcugccuggccucgcgcaagaccagcuucaugauggcgcugugccuuucuuccaucuaugaagauuuaaagauguaccaaguagaauuuaaaaccaugaaugccaaauuauuaauggaccccaaacggcagauauuuuuggaucaaaacaugcuggcugucauugaugagcucaugcaagcauuaaacuucaacucagaaacuguuccccagaagucaucuuuagaagagccagauuucuacaaaacaaaaauaaaacucugcauucuucuucaugccuuccgcauccgugcugucaccauugaccgugucauguccuacuuaaaugcuucuugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 351 - RNA, 1829 nt, Artificial Sequence
  Synthetic: hIL12AB_020 (5UTR ORF  3UTR)
ucaagcuuuuggacccucguacagaagcuaauacgacucacuauagggaaauaagagagaaaagaagaguaagaagaaauauaagagccaccaugugccaccagcagcuggugaucagcugguucagccugguguuccuggcuagcccucugguggccaucugggagcugaagaaggacguguacgugguggaguuggauugguaccccgacgcucccggcgagaugguggugcugaccugcgacacccccgaggaggacgggaucaccuggacccuggaucagucaagcgaggugcugggaagcggcaagacccugaccauccaggugaaggaguucggcgacgccggccaauacacuugccacaagggaggcgaggugcugucccacucccuccugcugcugcacaaaaaggaagacggcaucuggagcaccgacauccugaaagaccagaaggagccuaagaacaaaacauuccucagaugcgaggccaagaauuacuccgggagauucaccuguugguggcugaccaccaucagcacagaccugaccuucagcgugaagagcagcagaggcagcagcgacccccagggcgugaccuguggcgccgccacccugagcgccgaaagagugcgcggcgacaacaaggaguacgaguacuccguggaaugccaggaagauagcgccugccccgccgccgaggagagccugcccaucgaggugaugguggacgccguccacaagcugaaguacgagaacuacaccucuagcuucuucaucagagauaucaucaagcccgauccccccaagaaccugcagcugaaaccccugaagaacagccggcagguggaggugagcugggaguaucccgacaccugguccaccccccacagcuauuuuagccugaccuucugcgugcaagugcagggcaagagcaagagagagaagaaggaccgcguguucaccgacaaaaccagcgccaccgugaucugcagaaagaacgccagcaucagcgugagggcccaggauagauacuacaguuccagcuggagcgagugggccagcgugcccugcagcggcggcggcgggggaggcucgagaaaccugcccguggcuacccccgaucccggaauguuccccugccugcaccacagccagaaccugcugagggcgguguccaacaugcuucagaaggcccggcagacccuggaguucuaccccuguaccucugaggagaucgaucaugaagauaucacaaaagauaaaaccagcaccguggaggccugccugccccuggagcugaccaagaacgagagcugccugaacucccgcgagaccagcuucaucacgaacggcagcugccuggccagcaggaagaccuccuucaugauggcccugugccugagcagcaucuacgaggaccugaaaauguaccagguggaguuuaagaccaugaacgccaagcugcugauggaccccaagcggcaaaucuuccuggaccagaacaugcuggcagugaucgacgagcucaugcaggcccugaacuucaauagcgagacggucccccagaagagcagccuggaggagcccgacuuuuacaagaccaagaucaagcugugcauccugcugcacgccuuuagaauccgugccgugaccauugacagagugaugagcuaccugaaugccagcugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 352 - RNA, 1829 nt, Artificial Sequence
  Synthetic: hIL12AB_021 (5UTR ORF  3UTR)
ucaagcuuuuggacccucguacagaagcuaauacgacucacuauagggaaauaagagagaaaagaagaguaagaagaaauauaagagccaccaugugccaccagcagcuggugaucagcugguucagccugguguuccuggccagcccucugguugccaucugggagcugaagaaagacguguacgucguggaacuggacugguauccggacgccccgggcgagaugguggugcugaccugugacacccccgaggaggacggcaucaccuggacgcuggaccaauccuccgaggugcugggaagcggcaagacccugaccauccaggugaaggaauucggggacgccgggcaguacaccugccacaaggggggcgaagugcugucccacucgcugcugcuccugcauaagaaggaggauggaaucugguccaccgacauccucaaagaucagaaggagcccaagaacaagacguuccugcgcugugaagccaagaauuauucggggcgauucacgugcugguggcugacaaccaucagcaccgaccugacguuuagcgugaagagcagcaggggguccagcgacccccagggcgugacgugcggcgccgccacccucuccgccgagagggugcggggggacaauaaggaguacgaguacagcguggaaugccaggaggacagcgccugccccgccgcggaggaaagccucccgauagaggugaugguggacgccgugcacaagcucaaguaugagaauuacaccagcagcuuuuucauccgggacauuaucaagcccgaccccccgaagaaccuccagcugaagccccugaagaacagccggcagguggaagucuccugggaguaucccgacaccuggagcaccccgcacagcuacuucucccugaccuucugugugcaggugcagggcaaguccaagagggaaaagaaggacaggguuuucaccgacaagaccagcgcgaccgugaucugccggaagaacgccagcauaagcguccgcgcccaagauagguacuacagcagcuccuggagcgagugggcuagcgugcccugcagcgggggcgggggugggggcuccaggaaccugccaguggcgacccccgaccccggcauguuccccugccuccaucacagccagaaccugcugagggccgucagcaauaugcugcagaaggccaggcagacccuggaauucuaccccugcacgucggaggagaucgaucacgaggauaucacaaaagacaagacuuccaccguggaggccugccugccccuggagcucaccaagaaugaguccugucugaacucccgggaaaccagcuucaucaccaacggguccugccuggccagcaggaagaccagcuuuaugauggcccugugccugucgagcaucuacgaggaccugaagauguaccaggucgaguucaagacaaugaacgccaagcugcugauggaccccaagaggcaaaucuuccuggaccagaauaugcuugccgucaucgacgagcucaugcaggcccugaacuucaacuccgagaccgugccccagaagagcagccuggaggagcccgacuucuacaagaccaagaucaagcugugcauccugcugcacgcguucaggauccgggcagucaccaucgaccgugugauguccuaccugaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 353 - RNA, 1829 nt, Artificial Sequence
  Synthetic: hIL12AB_022 (5UTR ORF  3UTR)
ucaagcuuuuggacccucguacagaagcuaauacgacucacuauagggaaauaagagagaaaagaagaguaagaagaaauauaagagccaccaugugccaucagcagcuggugaucagcugguucagccugguguuccucgccucuccccugguggccaucugggagcucaaaaaggacguguacgugguggagcucgacugguacccagacgcccccggggagaugguggugcugaccugcgacacccccgaagaagacggcaucacguggacccucgaccaguccagcgaggugcuggggagcgggaagacucugaccauccaggucaaggaguucggggacgccgggcaguacacgugccacaagggcggcgaagucuuaagccacagccugcuccugcugcacaagaaggaggacgggaucugguccacagacauacugaaggaccagaaggagccgaagaauaaaaccuuucugaggugcgaggccaagaacuauuccggcagguucacgugcugguggcuuacaacaaucagcacagaccugacguucagcgugaaguccagccgcggcagcagcgacccccagggggugaccugcggcgccgccacccugagcgccgagcgggugcgcggggacaacaaggaguacgaguacuccguggagugccaggaagacagcgccugucccgccgccgaagagagccugccuaucgaggucaugguagaugcagugcauaagcugaaguacgagaacuauacgagcagcuuuuucauacgcgacaucaucaagcccgacccccccaagaaccugcagcuuaagccccugaagaauagccggcagguggaggucuccugggaguaccccgacaccuggucaacgccccacagcuacuucucccugaccuuuuguguccaaguccagggaaagagcaagagggagaagaaagaucggguguucaccgacaagaccuccgccacggugaucugcaggaagaacgccagcaucuccgugagggcgcaagacagguacuacuccagcagcugguccgaaugggccagcgugcccugcuccggcggcgggggcggcggcagccgaaaccuacccguggccacgccggaucccggcauguuucccugccugcaccacagccagaaccuccugagggccguguccaacaugcugcagaaggccaggcagacucuggaguucuaccccugcacgagcgaggagaucgaucacgaggacaucaccaaggauaagaccagcacuguggaggccugccuuccccuggagcugaccaagaacgagagcugucugaacuccagggagaccucauucaucaccaacggcuccugccuggccagcaggaaaaccagcuucaugauggccuugugucucagcuccaucuacgaggaccugaagauguaucaggucgaguucaagacaaugaacgccaagcugcugauggaccccaaaaggcagaucuuccuggaccagaacaugcuggccgucaucgacgagcugaugcaggcccugaacuucaacagcgagacggugccccagaaaagcucccuggaggagcccgacuucuacaagaccaagaucaagcugugcauccugcugcacgccuucaggaucagggcagugaccaucgaccgggugaugucauaccuuaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 354 - RNA, 1829 nt, Artificial Sequence
  Synthetic: hIL12AB_023 (5UTR ORF  3UTR)
ucaagcuuuuggacccucguacagaagcuaauacgacucacuauagggaaauaagagagaaaagaagaguaagaagaaauauaagagccaccaugugccaucagcagcuggugaucuccugguucagccugguguuucuggccucgccccuggucgccaucugggagcugaagaaagacguguacgucgucgaacuggacugguaccccgacgcccccggggagaugguggugcugaccugcgacacgccggaggaggacggcaucaccuggacccuggaucaaagcagcgaggugcugggcagcggcaagacccugaccauccaagugaaggaauucggcgaugccggccaguacaccugucacaaagggggcgaggugcucagccacagccugcugcugcugcacaagaaggaggauggcaucuggagcaccgauauccugaaggaccagaaagagcccaagaacaagacguuccugaggugcgaggccaagaacuacagcgguagguucacguguugguggcugaccaccaucagcaccgaccugacguucagcgugaagagcuccaggggcagcuccgacccacagggggugacgugcggggccgcaacccucagcgccgaaagggugcggggggacaacaaggaguacgaauacuccguggagugccaggaagauucggccugccccgccgcggaggagagccuccccaucgagguaaugguggacgccgugcauaagcugaaguacgagaacuacaccagcucguucuucauccgagacaucaucaaacccgacccgcccaaaaaucugcagcucaagccccugaagaacuccaggcagguggaggugagcugggaguaccccgacaccugguccaccccgcacagcuacuucucccugacauucugcgugcaggugcagggcaagagcaagcgggagaagaaggacaggguguucaccgacaagacgagcgccaccgugaucugccgaaagaacgccagcaucucggugcgcgcccaggauagguacuauuccagcuccuggagcgagugggccucgguacccugcagcggcggcgggggcggcggcaguaggaaucugcccguggcuaccccggacccgggcauguuccccugccuccaccacagccagaaccugcugagggccgugagcaacaugcugcagaaggccagacagacgcuggaguucuaccccugcacgagcgaggagaucgaccacgaggacaucaccaaggauaaaacuuccaccgucgaggccugccugcccuuggagcugaccaagaaugaauccugucugaacagcagggagaccucguuuaucaccaauggcagcugccucgccuccaggaagaccagcuucaugauggcccucugucugagcuccaucuaugaggaccugaagauguaccagguggaguucaagaccaugaacgcgaagcugcugauggaccccaagaggcagaucuuccuggaucagaauaugcuggcggugaucgacgagcucaugcaggcccucaauuucaauagcgagacagugccccagaaguccucccuggaggagcccgacuucuacaagaccaagaucaagcuguguauccugcugcacgccuuccggauccgggccgucaccaucgaccgggucaugagcuaccucaaugccagcugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 355 - RNA, 1829 nt, Artificial Sequence
  Synthetic: hIL12AB_024 (5UTR ORF  3UTR)
ucaagcuuuuggacccucguacagaagcuaauacgacucacuauagggaaauaagagagaaaagaagaguaagaagaaauauaagagccaccaugugccaccagcagcuggugaucuccugguucucccugguguuccuggccucgccccugguggccaucugggagcugaagaaggacguguacgucguggagcucgacugguaccccgacgccccuggcgagaugguggugcugaccugcgacaccccagaggaggauggcaucaccuggacccuggaucaguccuccgaggugcugggcuccggcaagacgcugaccauccaagugaaggaguucggugacgccggacaguauaccugccauaagggcggcgagguccugucccacagccuccuccuccugcauaagaaggaggacggcaucuggagcaccgacauccugaaggaccagaaggagcccaagaacaagaccuuucugaggugcgaggccaagaacuacagcggccgauucaccugcugguggcucaccaccauauccaccgaccugacuuucuccgucaaguccucccggggguccagcgacccccagggagugaccugcggcgccgccacccucagcgccgagcgggugcggggggacaacaaggaguacgaauacuccgucgagugccaggaggacuccgccugcccggccgccgaggagagccugcccaucgaggugauggucgacgcggugcacaagcugaaguacgagaacuacaccagcaguuucuucaucagggauaucaucaagccagaucccccgaagaaucugcaacugaagccgcugaaaaacucacgacagguggaggugagcugggaguaccccgacacguggagcaccccacauuccuacuucagccugaccuucugcgugcagguccagggcaagagcaagcgggagaagaaggacaggguguucacggauaagaccagugccaccgugaucugcaggaagaacgccucuauuagcgugagggcccaggaucgguauuacuccucgagcuggagcgaaugggccuccgugcccugcagugggggggguggaggcgggagcaggaaccugcccguagcaacccccgaccccgggauguuccccugucugcaccacucgcagaaccugcugcgcgcggugagcaacaugcuccaaaaagcccgucagaccuuagaguucuaccccugcaccagcgaagaaaucgaccacgaagacaucaccaaggacaaaaccagcaccguggaggcgugccugccgcuggagcugaccaagaacgagagcugccucaacuccagggagaccagcuuuaucaccaacggcucgugccuagccagccggaaaaccagcuucaugauggcccugugccugagcuccauuuacgaggaccugaagauguaucagguggaguucaagaccaugaaugccaaacuccugauggaccccaagaggcagaucuuccuggaccagaacaugcucgcggugaucgaugagcugaugcaggcccugaacuuuaauagcgagaccgugccccagaaaagcagccuggaggagccggacuucuacaagaccaaaaucaagcugugcauccugcuccacgccuuccgcauccgggccgugaccaucgacagggugaugagcuaccugaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 356 - RNA, 1829 nt, Artificial Sequence
  Synthetic: hIL12AB_025 (5UTR ORF  3UTR)
ucaagcuuuuggacccucguacagaagcuaauacgacucacuauagggaaauaagagagaaaagaagaguaagaagaaauauaagagccaccaugugccaucagcagcuggugauuuccugguucucccugguguuccuggccagcccccucguggcgaucugggagcuaaagaaggacguguacgugguggagcuggacugguacccggacgcacccggcgagauggucguucugaccugcgauacgccagaggaggacggcaucaccuggacccucgaucagagcagcgagguccuggggagcggaaagacccugaccauccaggucaaggaguucggcgacgccggccaguacaccugccacaaagguggcgagguccugagccacucgcugcugcuccugcauaagaaggaggacggaaucuggagcacagacauccugaaagaccagaaggagcccaagaacaagaccuuccugaggugcgaggccaagaacuacagcgggcgcuucacgugcugguggcugaccaccaucagcacggaccucaccuucuccgugaagagcagccggggauccagcgauccccaaggcgucaccugcggcgcggccacccugagcgcggagagggucaggggcgauaauaaggaguaugaguacagcguggagugccaggaggacagcgccugcccggccgccgaggagucccugccaaucgaagugauggucgacgccgugcacaagcugaaguacgagaacuacaccagcagcuucuucauccgggauaucaucaagcccgaucccccgaagaaccugcagcugaagccccucaagaacagccggcagguggaggugaguugggaguaccccgacaccuggucaacgccccacagcuacuucucccugaccuucugugugcaggugcagggaaagagcaagagggagaagaaagaccgggucuucaccgacaagaccagcgccacggugaucugcaggaagaacgcaagcaucuccgugagggcccaggacagguacuacagcuccagcugguccgaaugggccagcgugcccuguagcggcggcgggggcgguggcagccgcaaccucccaguggccacccccgaccccggcauguuccccugccugcaccacagccagaaucugcugagggccgugaguaacaugcugcagaaggcaaggcaaacccucgaauucuaucccugcaccuccgaggagaucgaccacgaggauaucaccaaggacaagaccagcaccgucgaggccugucucccccuggagcugaccaagaaugagagcugccugaacagccgggagaccagcuucaucaccaacgggagcugccuggccuccaggaagaccucguucaugauggcgcugugccucucaagcauauacgaggaucugaagauguaccagguggaguuuaagacgaugaacgccaagcugcugauggacccgaagaggcagaucuuccuggaccagaacaugcuggccgugauagacgagcucaugcaggcccugaacuucaacuccgagaccgugccgcagaagucaucccucgaggagcccgacuucuauaagaccaagaucaagcugugcauccugcuccacgccuuccggauaagggccgugacgaucgacagggugaugagcuaccuuaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 357 - RNA, 1829 nt, Artificial Sequence
  Synthetic: hIL12AB_026 (5UTR ORF  3UTR)
ucaagcuuuuggacccucguacagaagcuaauacgacucacuauagggaaauaagagagaaaagaagaguaagaagaaauauaagagccaccaugugccaccagcagcucgugaucagcugguucucccugguguuucucgccagcccccugguggccaucugggagcugaagaaggacguguacgugguggagcuggacugguacccugacgccccgggggagauggucgugcugaccugcgacacccccgaagaggacgguaucaccuggacccuggaccaguccagcgaggugcugggcagcggcaagacccugacuauucaagucaaggaguucggagacgccggccaguacaccugccacaaggguggagagguguuaucacacagccugcugcugcugcacaagaaggaagacgggaucuggagcaccgacauccugaaggaccagaaggagcccaaaaacaagaccuuccugcggugcgaggccaagaacuauucgggccgcuuuacgugcugguggcugaccaccaucagcacugaucucaccuucagcgugaaguccucccgggggucguccgacccccagggggugaccugcggggccgccacccuguccgccgagagagugaggggcgauaauaaggaguacgaguacagcguugagugccaggaagauagcgccugucccgccgccgaggagagccugcccaucgaggugaugguggacgccguccacaagcugaaguaugagaacuacaccucaagcuucuucaucagggacaucaucaaacccgauccgcccaagaaucugcagcugaagccccugaaaaauagcaggcagguggaggugagcugggaguaccccgacaccugguccaccccccauagcuauuucucccugacguucugcgugcaggugcaagggaagagcaagcgggagaagaaggaccggguguucaccgacaagaccuccgccaccgugaucuguaggaagaacgcgucgaucucggucagggcccaggacagguauuacagcagcagcuggagcgagugggcgagcgugcccugcucgggcggcggcggcggcgggagcagaaaucugcccguggccaccccagaccccggaauguuccccugccugcaccauucgcagaaccuccugagggccgugagcaacaugcugcagaaggcccgccagacgcuggaguucuaccccugcacgagcgaggagaucgaccacgaagacaucaccaaggacaaaaccagcaccguggaggccugccugccccuggagcugaccaaaaacgaauccugccucaacagccgggagaccagcuucaucaccaacggcagcugccuggccagccgaaagaccuccuucaugauggcccucugccugagcagcaucuaugaggaucugaagauguaucagguggaguucaagaccaugaaugccaagcugcugauggaccccaagaggcagauauuccuggaccagaauaugcuggccgugaucgacgagcugaugcaggcccugaacuucaacagcgagaccgucccccagaaguccagccuggaggagccggacuuuuacaaaacgaagaucaagcugugcauacugcugcacgccuucaggauccgggccgugacaaucgacagggugauguccuaccugaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 358 - RNA, 1829 nt, Artificial Sequence
  Synthetic: hIL12AB_027 (5UTR ORF  3UTR)
ucaagcuuuuggacccucguacagaagcuaauacgacucacuauagggaaauaagagagaaaagaagaguaagaagaaauauaagagccaccaugugucaccagcagcuggugaucagcugguucucccugguguuccuggccagcccccugguggccaucugggagcucaagaaggacgucuacgucguggagcuggauugguaccccgacgcucccggggagaugguggugcugaccugcgacacccccgaggaggacggcaucaccuggacgcuggaccagagcucagaggugcugggaagcggaaagacacugaccauccaggugaaggaguucggggaugccgggcaguauaccugccacaagggcggcgaagugcugagccauucccugcugcugcugcacaagaaggaggacggcauaugguccaccgacauccugaaggaucagaaggagccgaagaauaaaaccuuccugaggugcgaggccaagaauuacagcggccgauucaccugcugguggcugaccaccaucagcaccgaccugaccuucagugugaaguccucacggggcagcucagauccccagggcgugaccugcggggccgcgacacucagcgccgagcgggugaggggugauaacaaggaguacgaguauucuguggagugccaggaagacuccgccugucccgccgccgaggagucccugcccaucgaggugaugguggacgccgugcauaaacugaaguacgagaacuacaccuccagcuucuucauccgggauauaaucaagcccgacccuccgaaaaaccugcagcugaagccccuuaaaaacagccggcagguggaggugagcugggaguaccccgacaccuggagcaccccccauagcuauuucagccugaccuucugcgugcaggugcaggggaaguccaagcgcgagaaaaaggaccggguguucaccgacaagacgagcgccaccgugaucugccggaagaacgccaguauaagcguaagggcccaggauagguacuacagcuccagcuggucggagugggccuccgugcccuguuccggcggcgggggggguggcagcaggaaccuccccguggccacgccggaccccggcauguucccgugccugcaccacucccaaaaccuccugcgggccgucagcaacaugcugcaaaaggcgcggcagacccuggaguuuuaccccuguaccuccgaagagaucgaccacgaggauaucaccaaggauaagaccuccaccguggaggccugucucccccuggagcugaccaagaacgagagcugucuuaacagcagagagaccucguucauaacgaacggcuccugccucgcuuccaggaagacgucguucaugauggcgcugugccuguccagcaucuacgaggaccugaagauguaucaggucgaguucaaaaccaugaacgccaagcugcugauggaccccaagaggcagaucuuccuggaccagaacaugcucgccgugaucgacgagcugaugcaggcccugaacuucaacagcgaaaccgugccccagaagucaagccuggaggagccggacuucuauaagaccaagaucaagcuguguauccugcuacacgcuuuucguauccgggccgugaccaucgacaggguuaugucguacuugaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 359 - RNA, 1829 nt, Artificial Sequence
  Synthetic: hIL12AB_028 (5UTR ORF  3UTR)
ucaagcuuuuggacccucguacagaagcuaauacgacucacuauagggaaauaagagagaaaagaagaguaagaagaaauauaagagccaccaugugccaccaacagcucgugaucagcugguucagccugguguuccuggccagcccgcugguggccaucugggagcugaagaaggacguguacgugguggagcuggacugguaccccgacgcccccggcgagauggugguccugaccugcgacacgccggaagaggacggcaucaccuggacccuggaucaguccagcgaggugcugggcuccggcaagacccugaccauucaggugaaggaguucggcgacgccggucaguacaccugccacaagggcggcgaggugcugagccacagccuacugcuccugcacaaaaaggaggauggaaucugguccaccgacauccucaaggaccagaaggagccgaagaacaagacguuccuccggugcgaggccaagaacuacagcggcagguuuaccugcugguggcugaccaccaucagcaccgaccugacauuuuccgugaagagcagccgcggcagcagcgauccccagggcgugaccugcggggcggccacccuguccgccgagcgugugaggggcgacaacaaggaguacgaguacagcguggaaugccaggaggacagcgccugucccgccgccgaggagagccugccaaucgaggucaugguggacgccgugcacaagcugaaguacgagaacuacacgagcagcuucuucaucagggacaucaucaaaccggacccgcccaagaaccugcagcugaaacccuugaaaaacagcaggcagguggaagugucuugggaguaccccgacaccugguccaccccccacagcuacuuuagccugaccuucugugugcagguccagggcaaguccaagagggagaagaaggacaggguguucaccgacaaaaccagcgccaccgugaucugcaggaagaacgccuccaucagcgugcgggcccaggacagguauuacagcucgucguggagcgagugggccagcgugcccugcuccgggggaggcggcggcggaagccggaaucugcccguggccacccccgaucccggcauguucccgugucugcaccacagccagaaccugcugcgggccgugagcaacaugcugcagaaggcccgccaaacccuggaguucuaccccuguacaagcgaggagaucgaccaugaggacauuaccaaggacaagaccagcaccguggaggccugccugccccucgagcucacaaagaacgaauccugccugaauagccgcgagaccagcuuuaucacgaacggguccugccucgccagccggaagacaagcuucaugauggcccugugccugagcagcaucuacgaggaccugaaaauguaccaaguggaguucaaaacgaugaacgccaagcugcugauggaccccaagcgccagaucuuccuggaccagaacaugcuggccgucaucgacgagcucaugcaggcccugaacuucaacagcgagaccgugccccagaagagcagccuggaggagcccgacuucuacaagacgaagaucaagcucugcauccugcugcacgcuuuccgcauccgcgcggugaccaucgaccgggugaugagcuaccucaacgccaguugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 360 - RNA, 1829 nt, Artificial Sequence
  Synthetic: hIL12AB_029 (5UTR ORF  3UTR)
ucaagcuuuuggacccucguacagaagcuaauacgacucacuauagggaaauaagagagaaaagaagaguaagaagaaauauaagagccaccaugugccaccaacagcuggugaucagcugguucagccugguguuucuggccuccccucugguggccaucugggagcugaagaaggacguguacgugguggagcuggacugguacccugacgcccccggcgaaaugguggugcugacgugcgacacccccgaggaggauggcaucaccuggacccuggaccaaagcagcgagguccucggaagcggcaagacccucacuauccaagugaaggaguucggggaugcgggccaguacaccugccacaagggcggcgaggugcugucucauagccugcugcuccugcauaagaaggaagacggcaucuggagcaccgacauacugaaggaucagaaggagcccaagaacaagaccuuccugaggugcgaggccaagaacuacuccgggcgcuucaccuguugguggcugaccaccaucuccaccgaccugaccuucagcgugaagagcagcagggggagcagcgacccccagggggugaccugcggagccgcgaccuugucggccgagcgggugaggggcgacaauaaggaguacgaguacucggucgaaugccaggaggacuccgccugccccgccgccgaggagucccuccccaucgaagugaugguggacgccguccacaagcugaaguacgagaacuacaccagcagcuucuucauacgggauaucaucaagcccgaccccccgaagaaccugcagcugaaacccuugaagaacuccaggcagguggaggugagcugggaguaccccgacaccugguccaccccgcacucauacuucagccugaccuucuguguacagguccagggcaagagcaagagggaaaagaaggauaggguguucaccgacaagaccuccgccacggugaucugucggaaaaacgccagcaucuccgugcgggcccaggacagguacuauuccagcagcuggagcgagugggccuccguccccugcuccggcggcgguggcgggggcagcaggaaccuccccguggccacccccgaucccgggauguucccaugccugcaccacagccaaaaccugcugagggccgucuccaauaugcugcagaaggcgaggcagacccuggaguucuaccccuguaccuccgaggagaucgaccacgaggauaucaccaaggacaagaccuccacggucgaggcgugccugccccuggagcucacgaagaacgagagcugccuuaacuccagggaaaccucguuuaucacgaacggcagcugccuggcgucacggaagaccuccuuuaugauggcccuaugucuguccucgaucuacgaggaccugaagauguaccagguggaguucaagaccaugaacgccaagcugcugauggaucccaagaggcagauuuuccuggaccagaacaugcuggccgugauugacgagcugaugcaggcgcugaacuucaacagcgagacagugccgcagaagagcucccuggaggagccggacuuuuacaagaccaagauaaagcugugcauccugcuccacgccuucagaauacgggccgucaccaucgauagggugaugucuuaccugaacgccuccugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 361 - RNA, 1829 nt, Artificial Sequence
  Synthetic: hIL12AB_030 (5UTR ORF  3UTR)
ucaagcuuuuggacccucguacagaagcuaauacgacucacuauagggaaauaagagagaaaagaagaguaagaagaaauauaagagccaccaugugccaccagcagcuggugauuagcugguuuagccugguguuccuggcaagcccccugguggccaucugggaacugaaaaaggacguguacguggucgagcuggauugguaccccgacgcccccggcgaaaugguggugcugacgugugauacccccgaggaggacgggaucaccuggacccuggaucagagcagcgaggugcuggggagcgggaagacccugacgauccaggucaaggaguucggcgacgcugggcaguacaccugucacaagggcggggaggugcugucccacucccugcugcuccugcauaagaaagaggacggcaucugguccaccgacauccucaaggaccagaaggagcccaagaacaagaccuuccugcggugugaggcgaagaacuacagcggccguuucaccugcugguggcugacgacaaucagcaccgacuugacguucuccgugaaguccuccagaggcagcuccgacccccaaggggugacgugcggcgcggccacccugagcgccgagcgggugcggggggacaacaaggaguacgaguacuccguggagugccaggaggacagcgccugucccgcagccgaggagucccugcccaucgaagucaugguggacgccguccacaagcugaaguacgagaacuacaccagcagcuucuucauccgcgauaucaucaagcccgauccccccaaaaaccugcaacugaagccgcugaagaauagcaggcagguggagguguccugggaguacccggacaccuggagcacgccccacagcuauuucagccugaccuuuugcgugcagguccaggggaagagcaagcgggagaagaaggaccgcguguuuacggacaaaaccagcgccaccgugaucugcaggaagaacgccagcaucagcgugagggcccaggacagguacuacagcagcuccuggagcgagugggccuccgugcccuguuccggaggcggcgggggcgguucccggaaccucccgguggccacccccgacccgggcauguucccgugccugcaccacucacagaaucugcugagggccgugagcaauaugcugcagaaggcaaggcagacccuggaguuuuaucccugcaccagcgaggagaucgaccacgaagacaucaccaaggacaagaccagcacaguggaggccugccugccccuggaacugaccaagaacgaguccugucugaacucccgggaaaccagcuucauaaccaacggcuccugucucgccagcaggaagaccagcuucaugauggcccugugccucagcuccaucuacgaggaccucaagauguaccagguugaguucaagaccaugaacgccaagcuccugauggaccccaagaggcagaucuuccuggaccagaauaugcuggccgugaucgaugaguuaaugcaggcgcugaacuucaacagcgagacggugccccaaaaguccucgcuggaggagcccgacuucuacaagaccaagaucaagcugugcauccuccugcacgccuuccgaauccgggccguaaccaucgacagggugaugagcuaucucaacgccuccugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 362 - RNA, 1829 nt, Artificial Sequence
  Synthetic: hIL12AB_031 (5UTR ORF  3UTR)
ucaagcuuuuggacccucguacagaagcuaauacgacucacuauagggaaauaagagagaaaagaagaguaagaagaaauauaagagccaccaugugccaccagcagcucgugaucagcugguucucgcuuguguuccuggccuccccccucgucgccaucugggagcugaagaaagacguguacgugguggagcuggacugguaucccgacgccccgggggagaugguggugcugaccugcgacaccccggaagaggacggcaucaccuggacgcucgaccagucguccgaagugcuggggucgggcaagacccucaccauccaggugaaggaguucggagacgccggccaguacaccugucauaaggggggggaggugcugagccacagccuccugcuccugcacaaaaaggaggacggcaucuggagcaccgauauccucaaggaccagaaggagcccaagaacaagacguuccugaggugugaggccaagaacuacagcgggcgguucacguguugguggcucaccaccaucuccaccgaccucaccuucuccgugaagucaagcaggggcagcuccgacccccaaggcgucaccugcggcgccgccacccugagcgccgagagggucaggggggauaacaaggaauacgaguacaguguggagugccaagaggauagcgccugucccgccgccgaagagagccugcccaucgaagugaugguggacgccgugcacaagcugaaguacgagaacuacaccuccagcuucuucaucagggauaucaucaagcccgauccccccaagaaccugcagcugaagccccugaagaacagcaggcagguggaggugagcugggaguaucccgacacguggagcaccccgcacagcuacuucucgcugaccuucugcgugcaggugcaagggaaguccaagagggagaagaaggauaggguguucaccgacaaaacgagcgccaccgugaucugccggaagaaugccagcaucucugugagggcccaggacagguacuauuccagcuccuggucggagugggccagcgugcccuguagcggcgggggcgggggcggcagcaggaaccucccgguugccacccccgaccccggcauguuuccgugccugcaccacucgcaaaaccugcugcgcgcggucuccaacaugcugcaaaaagcgcgccagacgcuggaguucuaccccugcaccagcgaggagaucgaucaugaagauaucaccaaagacaagaccucgaccguggaggccugccugccccuggagcucaccaagaacgaaagcugccugaacagcagggagacaagcuucaucaccaacggcagcugccuggccucccggaagaccagcuucaugauggcccugugccuguccagcaucuacgaggaucugaagauguaccaaguggaguuuaagaccaugaacgccaagcuguuaauggaccccaaaaggcagaucuuccuggaucagaacaugcuggccgucaucgacgagcugaugcaagcccugaacuucaacagcgagacggugccccagaagagcagccucgaggagcccgacuucuauaagaccaagauaaagcugugcauucugcugcacgccuucagaaucagggccgugaccaucgauagggugaugagcuaccugaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 363 - RNA, 1829 nt, Artificial Sequence
  Synthetic: hIL12AB_032 (5UTR ORF  3UTR)
ucaagcuuuuggacccucguacagaagcuaauacgacucacuauagggaaauaagagagaaaagaagaguaagaagaaauauaagagccaccaugugucaccagcagcuggugauuuccugguucagucugguguuucuugccagcccccugguggccaucugggagcugaagaaagacguauacgucguggagcuggacugguaucccgacgcucccggcgagauggugguccucaccugcgacaccccagaggaggacggcaucaccuggacccuggaccagagcuccgagguccugggcagcgguaagacccucaccauccaggugaaggaguuuggugaugccgggcaguauaccugccacaagggcggcgaggugcugucccacagccuccuguuacugcauaagaaggaggauggcaucuggagcaccgacauccucaaggaccagaaagagcccaagaacaagaccuuucugcggugcgaggcgaaaaauuacuccggccgguucaccugcugguggcugaccaccaucagcacggaccugacguucuccgugaagucgagcagggggagcuccgauccccagggcgugaccugcggcgcggccacccugagcgccgagcgcguccgcggggacaauaaggaauacgaauauagcguggagugccaggaggacagcgccugccccgcggccgaggagagccucccgaucgaggugaugguggaugccguccacaagcucaaauacgaaaacuacaccagcagcuucuucauuagggacaucaucaagcccgacccccccaaaaaccugcagcugaagccccugaagaacagccgccaggucgaggugucaugggaguacccagacaccuggagcaccccccacuccuacuucagccugaccuucugcguccaggugcagggaaaguccaaacgggagaagaaggauagggucuuuaccgauaagacgucggccaccgucaucugcaggaagaacgccagcauaagcgugcgggcgcaggaucgguacuacagcucgagcugguccgaaugggccuccgugcccuguagcggaggggguggcgggggcagcaggaaccugcccguggccaccccggacccgggcauguuucccugccugcaucacagucagaaccugcugagggccgugagcaacaugcuccagaaggcccgccagacccuggaguuuuaccccugcaccagcgaagagaucgaucacgaagacaucaccaaagacaagaccuccaccguggaggccugucugccccuggagcugaccaagaacgagagcugucugaacagcagggagaccuccuucaucaccaacggcuccugccuggcaucccggaagaccagcuucaugauggcccugugucugagcucuaucuacgaggaccugaagauguaccaggucgaguucaagaccaugaacgccaagcugcugauggaccccaagcgacagauauuccuggaccagaacaugcucgccgugaucgaugaacugaugcaagcccugaacuucaauagcgagaccgugccccagaaaagcagccuggaggagcccgacuucuacaagaccaagaucaaacugugcauacugcugcacgcguucaggauccgggccgucaccaucgaccgggugauguccuaucugaaugccagcugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 364 - RNA, 1829 nt, Artificial Sequence
  Synthetic: hIL12AB_033 (5UTR ORF  3UTR)
ucaagcuuuuggacccucguacagaagcuaauacgacucacuauagggaaauaagagagaaaagaagaguaagaagaaauauaagagccaccaugugccaccagcagcucgugauuagcugguuuucgcugguguuccuggccagcccucucguggccaucugggagcugaaaaaagacguguacgugguggagcuggacugguacccggacgcccccggcgagaugguggugcugacgugcgacaccccggaagaggacggcaucaccuggacccuggaccagucauccgagguccugggcagcggcaagacgcucaccauccaggugaaggaguucggcgacgccggccaguacacaugccauaagggcggggaggugcugagccacagccugcuccuccugcacaagaaggaggauggcaucuggucuacagacauccugaaggaccagaaagagcccaagaacaagaccuuccuccggugcgaggccaagaacuacuccgggcgguuuacuuguugguggcugaccaccaucagcaccgaccucaccuucagcgugaagagcucccgagggagcuccgacccccagggggucaccugcggcgccgccacccugagcgccgagcgggugaggggcgacaacaaggaguaugaauacagcguggaaugccaagaggacagcgccugucccgcggccgaggaaagccugcccaucgaggugaugguggacgccguccacaaacucaaguacgagaacuacaccagcaguuucuucauucgcgacaucaucaagccggacccccccaaaaaccugcagcucaaaccccugaagaacagcaggcagguggaggucagcugggaguacccggacaccuggagcaccccccauagcuacuucagccugaccuucugcgugcaggugcagggcaagagcaaacgcgagaagaaggaccggguguuuaccgacaagaccagcgccacggugaucugccgaaagaaugcaagcaucuccgugagggcgcaggaccgcuacuacucuagcagcuggagcgagugggccagcgugcccugcagcgguggcggcggaggcggcagccguaaccuccccguggccacccccgaccccggcauguucccgugucugcaccacucccagaaccugcugagggccgucagcaauaugcugcagaaggcccggcagacgcuggaguucuaccccugcaccuccgaggagaucgaccaugaggacauuaccaaggacaagacgagcacuguggaggccugccugccccuggagcucaccaaaaacgagagcugccugaauagcagggagacguccuucaucaccaacggcagcugucuggccagcaggaagaccagcuucaugauggcccugugccucuccuccauauaugaggaucugaagauguaccagguggaguucaagaccaugaacgccaagcugcugauggaucccaagaggcagaucuuccuggaccagaauaugcuggccgugauugacgagcugaugcaggcccugaacuuuaauagcgagaccgucccccagaagagcagccuggaggagcccgacuucuauaagaccaagaucaagcugugcauacugcugcacgcguuuaggauaagggccgucaccaucgacagggugaugagcuaccugaaugccagcugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 365 - RNA, 1829 nt, Artificial Sequence
  Synthetic: hIL12AB_034 (5UTR ORF  3UTR)
ucaagcuuuuggacccucguacagaagcuaauacgacucacuauagggaaauaagagagaaaagaagaguaagaagaaauauaagagccaccaugugccaccaacagcuggugaucuccugguucagccugguguuccucgccagcccccugguggccaucugggagcugaagaaagacguguacgugguggagcuggacugguaucccgacgcccccggcgagauggucgugcugaccugcgacaccccggaggaggacggcaucaccuggacccuggaucaguccuccgaggugcugggcagcgggaagacccugaccauccaggugaaagaguucggagaugccggccaguauaccugucacaaggggggugaggugcugagccauagccucuugcuucugcacaagaaggaggacggcaucugguccaccgacauccucaaggaccaaaaggagccgaagaauaaaacguuccugaggugcgaagccaagaacuauuccggacgguucaccugcugguggcugaccaccaucagcaccgaccucaccuucuccguaaagucaagcaggggcagcuccgacccccagggcgugaccugcggagccgccacccugagcgcagagagggugaggggcgacaacaaggaguacgaauacuccgucgagugccaggaggacagcgccugccccgccgccgaggaaagucugcccaucgaggugaugguggacgccgugcacaagcucaaauacgagaacuacaccagcagcuucuucauccgggauaucaucaagcccgacccuccaaagaaucugcagcugaaaccccuuaagaacagcaggcagguggaggucagcugggaguaccccgacaccuggagcacgccccacuccuacuuuagccugaccuuuugcgugcaggugcaggggaaaagcaagcgggagaagaaggacaggguguucaccgauaagaccuccgcuaccgugaucugcaggaagaacgccucaaucagcgugagggcccaggaucgguacuacuccagcuccuggagcgagugggccagcgugcccugcucuggcgguggcggcgggggcagccggaaccugccgguggccacucccgacccgggcauguucccgugccuccaccauucccagaaccugcugcgggccguguccaauaugcuccagaaggcaaggcagacccuggaguucuaccccugcaccagcgaggagaucgaucacgaggacaucaccaaagacaaaaccagcacggucgaggccugccugccccuggaacucaccaagaacgaaagcugucucaacagccgcgagaccagcuucauaaccaacgguuccugucuggccucccgcaagaccagcuuuaugauggcccucugucugagcuccaucuaugaagaccugaaaauguaccagguggaguucaaaaccaugaacgccaagcuucugauggaccccaagaggcagaucuuccuggaucagaacaugcuggccgugaucgacgagcugaugcaggcccugaacuuuaacuccgagaccgugccccagaaaagcagccuggaagagcccgauuucuacaaaacgaagaucaagcugugcauccugcugcacgccuuccggauccgugcggugaccaucgauagggugaugagcuaccugaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 366 - RNA, 1829 nt, Artificial Sequence
  Synthetic: hIL12AB_035 (5UTR ORF  3UTR)
ucaagcuuuuggacccucguacagaagcuaauacgacucacuauagggaaauaagagagaaaagaagaguaagaagaaauauaagagccaccaugugccaccaacagcugguaaucagcugguucagccugguuuuccucgcgucgccccugguggccaucugggaguuaaagaaggacguguacgugguggagcuggauugguaccccgacgccccgggcgagauggucgugcucaccugcgauacccccgaggaggacgggaucaccuggacccuggaccaauccagcgaggugcugggcagcggcaagacccugaccauacaggugaaggaauuuggggacgccgggcaguacaccugccacaagggcggggaagugcugucccacucccuccugcugcugcauaagaaggaggacggcaucuggagcaccgacauccugaaggaccaaaaggagcccaagaacaagaccuuccugaggugcgaggccaaaaacuauuccggccgcuuuaccuguugguggcugaccaccaucuccaccgaucugaccuucagcgugaagucgucuaggggcuccuccgacccccagggcguaaccugcggcgccgcgacccugagcgccgagagggugcggggcgauaacaaagaguacgaguacucgguggagugccaggaggacagcgccuguccggcggccgaggagagccugcccaucgaggugaugguggacgccguccacaagcugaaguacgagaacuacaccaguucguucuucaucagggacaucaucaagccggacccccccaagaaccuccagcugaagccccugaagaacagcaggcagguggaaguguccugggaguaucccgacaccuggagcaccccccacagcuacuucagccugaccuuuugcgugcaggugcagggcaaaagcaagagggaaaagaaggaccggguguucaccgauaagacgagcgccaccguuaucugcaggaagaacgccuccauaagcgugagggcgcaggaccguuacuacagcagcagcuggagugagugggcaagcgugcccuguagcggcgggggcgggggcgggucccgcaaccuccccgucgccacccccgacccaggcauguuuccgugccugcaccacagccagaaccugcugcgggccguuagcaacaugcugcagaaggccaggcagacccucgaguucuaucccugcacaucugaggagaucgaccacgaagacaucacuaaggauaagaccuccaccguggaggccugucugccccucgagcugaccaagaaugaauccugccugaacagccgagagaccagcuuuaucaccaacggcuccugccuggccagcaggaagaccuccuucaugauggcccugugccucuccagcaucuacgaggaucugaagauguaccagguagaguucaagacgaugaacgccaagcuccugauggaccccaagaggcagauauuccuggaccagaacaugcuggcggugaucgacgagcugaugcaggcccugaauuucaacagcgagacggugccacagaaguccagccuggaggagccagacuucuacaagaccaagaucaaacugugcauccuccugcacgcguucaggauccgcgccgucaccauagacagggugaugaguuaucugaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 367 - RNA, 1829 nt, Artificial Sequence
  Synthetic: hIL12AB_036 (5UTR ORF  3UTR)
ucaagcuuuuggacccucguacagaagcuaauacgacucacuauagggaaauaagagagaaaagaagaguaagaagaaauauaagagccaccaugugccaucagcagcugguaaucagcugguuuagccugguguuccuggccagcccacugguggccaucugggagcugaagaaggacguguacgugguggaacuggacugguaccccgacgccccuggcgagauggugguacugaccugugacaccccggaggaagacgguaucaccuggacccuggaucagagcuccgaggugcugggcuccggcaagacacugaccauccaaguuaaggaauuuggggacgccggccaguacaccugccacaaggggggcgaggugcugucccacucccugcugcuucugcauaagaaggaggauggcaucugguccaccgacauacugaaggaccagaaggagcccaagaauaagaccuuccugagaugcgaggccaagaacuacucgggaagguucaccugcugguggcugaccaccaucagcaccgaccugaccuucuccgugaagagcucccggggcagcuccgacccccagggcguaaccuguggggccgcuacccuguccgccgagaggguccggggcgacaacaaggaauacgaguacagcguggagugccaggaggacuccgccugccccgccgccgaggagucgcugcccauagaggugaugguggacgccgugcacaagcucaaguacgagaauuacaccagcagcuucuuuaucagggacauaauuaagccggaccccccaaagaaucugcagcugaagccccugaagaauagccggcagguggaaguguccugggaguaccccgacaccuggagcaccccccacuccuauuucucacugacauucugcgugcaggugcaagggaaaagcaagagggagaagaaggauaggguguucaccgacaagacaagcgccaccgugaucugccgaaaaaaugccagcaucagcgugagggcccaggaucgguauuacagcagcuccuggagcgagugggccagcgugcccuguuccggcgggggagggggcggcucccggaaccugccgguggccacccccgacccuggcauguuccccugccugcaucacagccagaaccugcuccgggccgugucgaacaugcugcagaaggcccggcagacccucgaguuuuaccccugcaccagcgaagagaucgaccacgaagacauaaccaaggacaagaccagcacgguggaggccugccugccccuggagcuuaccaaaaacgaguccugccugaacagccgggaaaccagcuucauaacgaacgggagcugccuggccuccaggaagaccagcuucaugauggcgcugugucuguccagcauauacgaggaucugaagauguaucagguggaauucaaaacuaugaaugccaagcuccugauggaccccaagaggcagaucuuccuggaccagaacaugcuagccgugaucgacgagcugaugcaggcccucaacuucaacucggagacggugccccagaaguccagccucgaggagcccgacuucuacaagaccaagaucaagcugugcauacugcugcaugccuucaggauaagggcggugacuaucgacagggucauguccuaccugaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 368 - RNA, 1829 nt, Artificial Sequence
  Synthetic: hIL12AB_037 (5UTR ORF  3UTR)
ucaagcuuuuggacccucguacagaagcuaauacgacucacuauagggaaauaagagagaaaagaagaguaagaagaaauauaagagccaccaugugccaccaacaacuggugaucagcugguucucccugguguuccuggccagcccccugguggccaucugggagcucaaaaaagacguguacgugguggagcucgauugguacccagacgcgccgggggaaaugguggugcugaccugcgacaccccagaggaggauggcaucacguggacgcuggaucaguccagcgaggugcuggggagcggcaagacgcucaccauccaggugaaggaauuuggcgacgcgggccaguauaccugucacaagggcggcgaggugcugagccacucccugcugcugcugcacaagaaggaggaugggaucuggucaaccgauauccugaaagaccagaaggagcccaagaacaagaccuuccugcgcugcgaggccaagaacuauagcggcagguucaccugcugguggcugaccaccaucagcaccgaccugaccuucagcgugaaauccuccaggggcagcagcgacccccagggcgugaccugcggugccgccacgcucuccgccgagcgagugaggggugacaacaaggaguacgaguacagcguggaaugucaggaggacagcgccugucccgccgccgaggagucgcugcccaucgaggugauggucgacgcggugcacaagcucaaauacgagaauuacaccagcagcuucuucaucagggacaucaucaagcccgacccccccaagaaccugcagcugaagcccuugaagaacagcaggcagguggaggugagcugggaguacccggacaccuggagcaccccccacuccuacuucagccugacguucugugugcaggugcaggggaaguccaagagggagaagaaggaccggguguucaccgacaagaccagcgccaccgugauaugccgcaagaacgcguccaucagcguucgcgcccaggaccgcuacuacagcagcuccugguccgaaugggccagcgugcccugcagcgguggagggggcgggggcuccaggaaucugccgguggccacccccgaccccgggauguucccgugucugcaucacucccagaaccugcugcgggccgugagcaauaugcugcagaaggccaggcagacgcucgaguucuaccccugcaccuccgaagagaucgaccaugaggacaucaccaaggacaagaccagcaccguggaggccugccucccccuggagcugaccaaaaacgagagcugccugaacuccagggagaccagcuuuauaaccaacggcagcugccucgccuccaggaagaccucguuuaugauggcccucugccuguccagcaucuacgaggaccugaagauguaccagguggaguucaagaccaugaacgcgaaguugcucauggaccccaagaggcagaucuuccuggaccagaacaugcucgcggugaucgacgagcugaugcaagcccugaacuucaacagcgagaccgugccccagaagagcagccuggaagagcccgacuucuacaagaccaagaucaagcugugcauccugcugcacgccuuccggauccgggccgugaccaucgacagggugaugagcuaccucaacgccuccugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 369 - RNA, 1829 nt, Artificial Sequence
  Synthetic: hIL12AB_038 (5UTR ORF  3UTR)
ucaagcuuuuggacccucguacagaagcuaauacgacucacuauagggaaauaagagagaaaagaagaguaagaagaaauauaagagccaccaugugccaccagcagcucgugaucagcugguucucccucgucuuccuggccuccccgcugguggccaucugggagcugaagaaggacguguacgugguggagcuggacugguaucccgacgcccccggcgagaugguggugcugacgugcgacacaccagaagaggacgggaucacauggacccuggaucagucguccgaggugcuggggagcggcaagacccucaccauccaagugaaggaguucggggacgccggccaguacaccugccacaagggcggggaggugcucucccauagccugcuccuccugcacaaaaaggaggauggcaucuggagcaccgacauccugaaggaccagaaggagcccaagaacaagacauuucucaggugugaggccaagaacuauucgggcagguuuaccuguugguggcucaccaccaucucuaccgaccugacguucuccgucaagucaagcagggggagcucggacccccagggggugacauguggggccgccacccugagcgcggagcguguccgcggcgacaacaaggaguacgaguauuccguggagugccaggaggacagcgccugccccgccgccgaggagucccugcccauagaggugaugguggacgccguccacaaguugaaguacgaaaauuauaccuccucguucuucauuagggacaucaucaagccugaccccccgaagaaccuacaacucaagccccucaagaacucccgccagguggagguguccugggaguaccccgacaccugguccaccccgcacagcuacuucagccugaccuucugcgugcagguccaggggaagagcaagcgugaaaagaaagacaggguguucaccgacaagacgagcgccaccgugaucugcaggaaaaacgccuccaucuccgugcgcgcccaggacagguacuacaguagcuccuggagcgaaugggccagcgugccgugcagcggcgggggaggaggcggcagucgcaaccugcccguggccacccccgaccccggcauguucccaugccugcaccacagccagaaccugcugagggcagucagcaauaugcugcagaaggccaggcagacccuggaguuuuaucccugcaccagcgaggagaucgaccacgaggacaucaccaaggacaagaccuccaccgucgaggccugccugccacuggagcugaccaaaaacgagagcugccugaacuccagggagaccuccuucaucaccaacgggagcugccuggccagccggaagaccagcuucaugauggcgcugugccucagcagcaucuacgaggaucucaagauguaccagguggaguucaagaccaugaacgcgaagcugcugauggaccccaagcggcagaucuuccuggaccagaacaugcuggccgugauugacgagcucaugcaggcccugaacuucaauagcgagaccgucccccaaaagagcagccuggaggaacccgacuucuacaaaacgaagaucaagcucugcauccugcugcacgccuuccggauccgggccgugaccaucgaucgugugaugagcuaccugaacgccucgugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 370 - RNA, 1829 nt, Artificial Sequence
  Synthetic: hIL12AB_039 (5UTR ORF  3UTR)
ucaagcuuuuggacccucguacagaagcuaauacgacucacuauagggaaauaagagagaaaagaagaguaagaagaaauauaagagccaccaugugccaccagcagcucgucaucuccugguuuagccugguguuucuggccuccccccuggucgccaucugggagcugaagaaagacguguacgugguggagcuggacugguacccggacgcucccggggagaugguggugcugaccugcgacacccccgaggaggacggcaucaccuggacccuggaccagagcuccgaggugcuggggagcggcaagacccugaccauucaggugaaagaguucggcgacgccggccaauauaccugccacaaggggggggagguccugucgcauucccugcugcugcuucacaaaaaggaggauggcaucuggagcaccgacauccugaaggaccagaaagaacccaagaacaagacguuccugcgcugcgaggccaagaacuacagcggccgguucaccuguugguggcugaccaccaucuccaccgaccugacuuucucggugaagagcagccgcgggagcagcgacccccagggagugaccugcggcgccgccacccugagcgccgaaagggugaggggcgacaauaaagaguacgaguauuccguggagugccaggaggacagcgccugucccgccgccgaggagucccugccuaucgaggugauggucgacgcggugcacaagcucaaguacgaaaacuacaccagcagcuuuuucaucagggauaucaucaaaccagacccccccaagaaccugcagcugaagccccugaaaaacagcaggcagguggaagugagcugggaauaccccgauaccugguccaccccccacagcuacuucagccugaccuucugcgugcaggugcaggggaaguccaagcgggagaagaaagaucggguguucacggacaagaccagcgccaccgugauuugcaggaaaaacgccagcaucuccgugagggcucaggacagguacuacagcuccagcuggagcgagugggccuccgugccuugcagcgggggaggaggcggcggcagcaggaaucugcccgucgcaacccccgaccccggcauguuccccugccugcaccacagccagaaucugcugcgagccgugagcaacaugcuccagaaggcccggcagacgcuggaguucuaccccugcaccuccgaggagaucgaccacgaggacaucaccaaggauaagacgagcaccgucgaggccugucucccccuggagcucaccaagaacgaguccugccugaauagcagggagacguccuucauaaccaacggcagcugucuggcguccaggaagaccagcuucaugauggcccucugccugagcuccaucuacgaggaccucaagauguaccaggucgaguucaagaccaugaacgcaaaacugcucauggauccaaagaggcagaucuuucuggaccagaacaugcuggccgugaucgaugaacucaugcaggcccugaauuucaauuccgagaccgugccccagaagagcucccuggaggaacccgacuucuacaaaacaaagaucaagcuguguauccuccugcacgccuuccggaucagggccgucaccauugaccgggugauguccuaccugaacgccagcugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 371 - RNA, 1829 nt, Artificial Sequence
  Synthetic: hIL12AB_040 (5UTR ORF  3UTR)
ucaagcuuuuggacccucguacagaagcuaauacgacucacuauagggaaauaagagagaaaagaagaguaagaagaaauauaagagccaccaugugccaucagcagcuggugaucagcugguucagccucguguuccucgccagcccccucguggccaucugggagcugaaaaaggacguguacgugguggagcuggacugguaucccgacgccccgggcgagaugguggugcugaccugcgacacccccgaggaggacggcauuaccuggacacuggaccagagcagcgagguccugggcagcgggaagacccugacaauucaggugaaggaguucggcgacgccggacaguacacgugccacaaggggggggaggugcugucccacagccuccuccugcugcacaagaaggaggauggcaucuggagcaccgacauccugaaggaucagaaggagcccaagaacaagaccuuucugagaugcgaggccaagaauuacagcggccguuucaccugcugguggcucaccaccaucagcaccgaccugaccuucagcgugaaauccuccaggggcuccuccgacccgcagggagugaccugcggcgccgccacacugagcgccgagcgggucagaggggacaacaaggaguacgaguacagcguugagugccaggaggacagcgccugucccgcggccgaggaaucccugcccaucgaggugaugguggacgcagugcacaagcugaaguacgagaacuauaccucgagcuucuucauccgggauaucauuaagcccgaucccccgaagaaccugcagcucaaaccccugaagaacagcaggcagguggaggucuccugggaguaccccgacacaugguccaccccccauuccuauuucucccugaccuuuugcgugcaggugcagggcaagagcaagagggagaaaaaggacaggguguucaccgacaagaccuccgccaccgugaucugccguaagaacgcuagcaucagcgucagggcccaggacagguacuauagcagcuccugguccgagugggccagcgucccgugcagcggcgggggcgguggaggcucccggaaccuccccguggccaccccggaccccgggauguuucccugccugcaucacagccagaaccugcugagggccguguccaacaugcugcagaaggccaggcagacacucgaguuuuaccccugcaccagcgaggagaucgaccacgaagacaucaccaaggacaagaccuccaccguggaggcaugccugccccuggagcugaccaaaaacgaaagcugucugaacuccagggagaccuccuuuaucacgaacggcucaugccuggccuccagaaagaccagcuucaugauggcccugugccugagcuccaucuacgaggacuugaaaauguaccaggucgaguucaagaccaugaacgccaagcugcucauggaccccaaaaggcagaucuuucuggaccagaauaugcuggccgugaucgacgagcucaugcaagcccugaauuucaacagcgagaccgugccccagaaguccucccuggaggagcccgacuucuacaagaccaagaucaagcugugcauacuccugcacgcguuuaggaucagggcggugaccaucgauagggugaugagcuaccugaaugccuccugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 372 - RNA, 66 nt, Artificial Sequence
  Synthetic: IL12B signal peptide nucleotide sequence
augugccaccagcagcuggugaucagcugguucagccugguguuccuggccagcccccugguggcc

SEQ ID NO: 373 - RNA, 918 nt, Artificial Sequence
  Synthetic: IL-12B nucleotide sequence
aucugggagcugaagaaggacguguacgugguggaguuggauugguaccccgacgcccccggcgagaugguggugcugaccugcgacacccccgaggaggacggcaucaccuggacccuggaccagagcagcgaggugcugggcagcggcaagacccugaccauccaggugaaggaguucggcgacgccggccaguacaccugccacaagggcggcgaggugcugagccacagccugcugcugcugcacaagaaggaggacggcaucuggagcaccgacauccugaaggaccagaaggagcccaagaacaagaccuuccugagaugcgaggccaagaacuacagcggcagauucaccugcugguggcugaccaccaucagcaccgaccugaccuucagcgugaagagcagcagaggcagcagcgacccccagggcgugaccugcggcgccgccacccugagcgccgagagagugagaggcgacaacaaggaguacgaguacagcguggagugccaggaagauagcgccugccccgccgccgaggagagccugcccaucgaggugaugguggacgccgugcacaagcugaaguacgagaacuacaccagcagcuucuucaucagagauaucaucaagcccgacccccccaagaaccugcagcugaagccccugaagaacagccggcagguggaggugagcugggaguaccccgacaccuggagcaccccccacagcuacuucagccugaccuucugcgugcaggugcagggcaagagcaagagagagaagaaagauagaguguucaccgacaagaccagcgccaccgugaucugcagaaagaacgccagcaucagcgugagagcccaagauagauacuacagcagcagcuggagcgagugggccagcgugcccugcagc

SEQ ID NO: 374 - RNA, 21 nt, Artificial Sequence
  Synthetic: GGGGGGS nucleotide sequence
ggcggcggcggcggcggcagc

SEQ ID NO: 375 - RNA, 591 nt, Artificial Sequence
  Synthetic: IL-12A nucleotide sequence
agaaaccugcccguggccacccccgaccccggcauguuccccugccugcaccacagccagaaccugcugagagccgugagcaacaugcugcagaaggcccggcagacccuggaguucuaccccugcaccagcgaggagaucgaccacgaagauaucaccaaagauaagaccagcaccguggaggccugccugccccuggagcugaccaagaacgagagcugccugaacagcagagagaccagcuucaucaccaacggcagcugccuggccagcagaaagaccagcuucaugauggcccugugccugagcagcaucuacgaggaccugaagauguaccagguggaguucaagaccaugaacgccaagcugcugauggaccccaagcggcagaucuuccuggaccagaacaugcuggccgugaucgacgagcugaugcaggcccugaacuucaacagcgagaccgugccccagaagagcagccuggaggagcccgacuucuacaagaccaagaucaagcugugcauccugcugcacgccuucagaaucagagccgugaccaucgacagagugaugagcuaccugaacgccagc

SEQ ID NO: 376 - RNA, 78 nt, Artificial Sequence
  Synthetic: Linker nucleotide sequence
ucugguggcggaucaggcggcggcgguucaggaggcgguggaaguggagguggcgggucuggcggagguucacugcag

SEQ ID NO: 377 - RNA, 75 nt, Homo sapiens
  misc_feature (1)..(75): Human CD8 transmembrane nucleotide sequence
aucuacaucugggcuccacuggccggcaccugcggcgugcugcugcugagccuggugaucacccuguacugcuac

SEQ ID NO: 378 - RNA, 63 nt, Homo sapiens
  misc_feature (1)..(63): Human CD80 transmembrane domain nucleotide sequence
cugcugcccagcugggccaucacccugaucagcgugaacggcaucuucgugaucugcugccug

SEQ ID NO: 379 - RNA, 75 nt, Homo sapiens
  misc_feature (1)..(75): Human CD80 intracellular domain nucleotide sequence
accuacugcuucgccccucgaugcagagagagaagaagaaacgagagacugagaagagagagcgugcgacccgug

What is claimed is:

1. A lipid nanoparticle (LNP) comprising a messenger RNA (mRNA) comprising an open reading frame (ORF) encoding a human interleukin-12 (IL-12) polypeptide operably linked to a membrane domain, optionally via a linker, wherein the human IL-12 polypeptide comprises an IL-12 p40 subunit (IL-12B) polypeptide comprising amino acids 23 to 328 of SEQ ID NO: 48 operably linked to an IL-12 p35 subunit (IL-12A) polypeptide comprising amino acids 336 to 532 of SEQ ID NO: 48, wherein the membrane domain comprises a transmembrane domain comprising a CD80 transmembrane domain, a PDGFR transmembrane domain, or a CD8 transmembrane domain.

2. The LNP of claim 1, wherein the membrane domain comprises an intracellular domain.

3. The LNP of claim 1, wherein the membrane domain is operably linked to the IL-12A polypeptide by a peptide linker.

4. The LNP of claim 1, wherein the membrane domain is operably linked to the IL-12B polypeptide by a peptide linker.

5. The LNP of claim 1, wherein the IL-12B polypeptide is operably linked to the IL-12A polypeptide by a peptide linker.

6. The LNP of claim 1, wherein the IL-12B polypeptide is located at the 5' terminus of the IL-12A polypeptide, or the 5' terminus of the peptide linker.

7. The LNP of claim 1, wherein the IL-12A polypeptide is located at the 5' terminus of the IL-12B polypeptide, or the 5' terminus of the peptide linker.

8. A LNP comprising a mRNA comprising a 5' untranslated region (UTR), an ORF, and a 3' UTR, wherein the ORF comprises a nucleotide sequence encoding from 5' to 3':

5'-[IL-12B]-[L1]-[IL-12A]-[L2]-[MD]-3', wherein
IL-12B is a human IL-12 p40 subunit polypeptide comprising amino acids 23 to 328 of SEQ ID NO: 48,
L1 is a first peptide linker,
IL-12A is a human IL-12 p35 subunit polypeptide comprising amino acids 336 to 532 of SEQ ID NO: 48,
L2 is a second peptide linker, and
MD is a membrane domain comprising a CD80 transmembrane domain and a CD80 intracellular domain.

9. The LNP of claim 1, wherein the mRNA comprises a 3'UTR, wherein the 3'UTR comprises a microRNA binding site.

10. The LNP of claim 9, wherein the microRNA binding site is a miR-122 binding site.

11. The LNP of claim 10, wherein the miR-122 binding site is a miR-122-3p or miR-122-5p binding site.

12. The LNP of claim 1, wherein the mRNA comprises at least one chemical modification.

13. The LNP of claim 12, wherein the chemical modification is selected from the group consisting of pseudouridine or a pseudouridine analog.

14. The LNP of claim 12, wherein the chemical modification is N1-methylpseudouridine.

15. The LNP of claim 12, wherein the mRNA is fully modified with N1-methylpseudouridine.

16. A pharmaceutical composition comprising the LNP of claim 1 and a pharmaceutically acceptable carrier.

17. A pharmaceutical composition comprising the LNP of claim 8, and a pharmaceutically acceptable carrier.

18. The LNP of claim 1, wherein the CD80 transmembrane domain comprises the amino acid sequence set forth in SEQ ID NO: 103, the PDGFR transmembrane domain comprises a PDGFR beta transmembrane domain comprising the amino acid sequence set forth in SEQ ID NO: 102, and the CD8 transmembrane domain comprises the amino acid sequence set forth in SEQ ID NO: 101.

19. The LNP of claim 2, wherein the intracellular domain is a CD80 intracellular domain or a PDGFR intracellular domain.

20. The LNP of claim 19, wherein the CD80 intracellular domain comprises the amino acid sequence set forth in SEQ ID NO: 225 and the PDGFR intracellular domain comprises an amino acid sequence selected from SEQ ID NOs: 226-228.

21. The LNP of claim 1, wherein the IL-12 polypeptide comprises a signal peptide.

22. The LNP of claim 21, wherein the signal peptide is an IL-12B signal peptide comprising the amino acid sequence set forth in amino acids 1 to 22 of SEQ ID NO: 48.

23. The LNP of claim 1, wherein the IL-12 polypeptide is operably linked to the membrane domain via a peptide linker.

24. The LNP of claim 23, wherein the peptide linker is a Gly/Ser linker.

25. The LNP of claim 5, wherein the peptide linker is a Gly/Ser linker.

26. The LNP of claim 1, wherein the ORF encodes the amino acid sequence set forth in any one of SEQ ID NOs: 241, 243, 249, 253 and 255.

27. The LNP of claim 8, wherein the 3'UTR comprises a microRNA binding site.

28. The LNP of claim 27, wherein the microRNA binding site is a miR-122 binding site.

29. The LNP of claim 28, wherein the miR-122 binding site is a miR-122-3p or a miR-122-5p binding site.

30. The LNP of claim 8, wherein the mRNA comprises at least one chemical modification.

31. The LNP of claim 30, wherein the chemical modification is selected from the group consisting of pseudouridine or a pseudouridine analog.

32. The LNP of claim 30, wherein the chemical modification is N1-methylpseudouridine.

33. The LNP of claim 30, wherein the mRNA is fully modified with N1-methylpseudouridine.

34. The LNP of claim 8, wherein the CD80 transmembrane domain comprises the amino acid sequence set forth in SEQ ID NO: 103.

35. The LNP of claim 8, wherein the CD80 intracellular domain comprises the amino acid sequence set forth in SEQ ID NO: 225.

36. The LNP of claim 8, wherein the ORF encodes a signal peptide.

37. The LNP of claim 36, wherein the signal peptide is an IL-12B signal peptide comprising the amino acid sequence set forth in amino acids 1 to 22 of SEQ ID NO: 48.

38. The LNP of claim 8, wherein [L1] and [L2] are each a Gly/Ser linker.

39. The LNP of claim 8, wherein the ORF encodes the amino acid sequence set forth in SEQ ID NO: 249.

40. The LNP of claim 1, wherein the transmembrane domain comprises a CD80 transmembrane domain.

41. The LNP of claim 1, wherein the transmembrane domain comprises a CD8 transmembrane domain.

42. The LNP of claim 1, wherein the transmembrane domain comprises a PDGFR transmembrane domain.

43. The LNP of claim 1, wherein the LNP comprises an ionizable amino lipid, a phospholipid, a sterol, and a PEG-modified lipid.

44. The LNP of claim 43, wherein the LNP comprises a molar ratio of about 20-60% ionizable amino lipid: 5-25% phospholipid: 25-55% sterol: 0.5-15% PEG-modified lipid.

45. The LNP of claim 8, wherein the LNP comprises an ionizable amino lipid, a phospholipid, a sterol, and a PEG-modified lipid.

46. The LNP of claim 45, wherein the LNP comprises a molar ratio of about 20-60% ionizable amino lipid: 5-25% phospholipid: 25-55% sterol: 0.5-15% PEG-modified lipid.

* * * * *